United States Patent 7,745,391 (HUMAN THROMBOSPONDIN POLYPEPTIDE) - sequence listing, part 174

SEQ ID NO: 435035 - DNA, 5881 bp, Homo sapiens
aacacagtaggtcttaggaactctgctggaagagaacatgcttcctctcccctcctgccacactcctgaccaggcccccaagcagcagtcctcagggagctgcacccgtgccagtggccccctgccctggccccttgccttggggccgctcgtcctggtccccagccatggtggcaatgagaagggagcgccagggcagaccgtgtgagattcctgcagagcctcactgcctgcgctctccttcttgcagagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435036 - DNA, 5665 bp, Homo sapiens
aggttcaagcaattctcctgcctcagtctcctgagtagctgggattacaggtgcccaccaccacacccggctaatttttgtatttttagtagagatagagttttgccatgttggccagcctggtctcgaactgagctcaagtgatctgcccgcctctgcctcccaaactgctgggattatagcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435037 - DNA, 5177 bp, Homo sapiens
tccccaagtctgctttctgatatccagattccaggatccaaccatcagtgtcccgtttcaacctttgcagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435038 - DNA, 4626 bp, Homo sapiens
aacctataaagtggagaggacagcaactactcttgagggtaactggaatactgcaatgtcctaacctatgcaaaatgcctgaagtatcctgtaaagcttctctttccccagtggaagagaattcggaaagaaagcttatttacctaaaatgcatgttgatccctctctttctaaaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435039 - DNA, 6212 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435040 - DNA, 4878 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactgtgagtgtcttgcatactgatggactcatttggtggcatggttggctaacagcatggcggggggtgttcagcttgagacccatgcctgtgttcatttcccatggagctggcagcctggtctaccccaagtgcatgccccgcctctcctctctcccttgggtctgcctgcgtgcatgcttctccagttgcgtctgcgaagctacctactttcttgggagggtcgaccttgatcatgaaacaataccatgagggggcctctgtcacctttgaaaagaacactttttgagcagcctcaaaaagctcatacataccagcgccttcttaaattggctctaatgtaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctaggcaacactcgcggtctcaggctgcggtgggcgtctgtcctgcatgtggcccagaccaccctgacccccgggcctgcctgcctggccctgcatgctgcacgctcactgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435041 - DNA, 6536 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435042 - DNA, 6514 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgagtatagaaagtaaatttttgaggtcatgatgtgaacggccatgttattgtgattatcttcagctcaggataggctgagatgctttgtggagtgttccatgaagcccgagtcggaatctctgactgtcgtgtacagccataaggagactggtttgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatgggagacgctagagtaaaatgggggcagagaggatatcagggagcaagatgcaaactgtgtgcatccactctcgtaaacaagtagctggtcacaaccagaaaggttcatctctcctaagcaaacagcgactctttcagaggaagtttccctctttcaatcgtggccttattttcaactccggtgccttctcgtgatgttaatcatttccttttttccccacactaagctctcttttctatctttctctctctttccaatcttacgccatggccatcagttcatttcagccttccagtgctacacccacttcttggctgacacacttctgctctaaggtgactggttttcttgccaattttcaaagagtggtactaacccccaacccgctttccgcaccccgtcctctctgcgtttgcaaacgcagagaggacaggagggagttcatggccgaggactggttggagccggggatgttcatgggagaaggggtcagagatctctgcttgacacacctggttgatgtttcttactgtctcagagacacgctactggtgagtgatgtctgaagactcggacctcttcaactgcagctccttgcgcatcggtccctcaatatctgctgcccaggaatccatgcgaagcacgccca

SEQ ID NO: 435043 - DNA, 3954 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaaggtgactggttttcttgccaattttcaaagagtggtactaacccccaacccgctttccgcaccccgtcctctccgccagcagtactggttgcactaactagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435044 - DNA, 2735 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgaggtttgtgtacacagtgtggctttaaacagaggctcgtttcctgacaaccagtggccacaggcagcctcactgtggtagcagcctggccctgttccttccctctctcatgaaccactgggttccaagcttggcgtgatggaaaaacagttggggttttggatcacgcttcactacttactagctgtgtaaccttgagaaacacaacctcccaggatgtggttcatgtctgtaacgtgcaatgatacacttgaaatacatgaaacttggcaggacttttaaagatgaataagatgaacatggtatctgacacatgttaatcaatatacaaccactgttaacagtaaatagtaaagaggcatcagcactcccacttttctcccaa

SEQ ID NO: 435045 - DNA, 1311 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgtacgtacctcttggctgcgatttcccgacttcgcgacctgggctggtgacatcagcaggtgtgaaggcagatg

SEQ ID NO: 435046 - DNA, 856 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtgagtggagtctatggtgatatcccatgaagggaggggactgaccctgggtgggacatatctctccaggtctaggagtccccagcttgttccat

SEQ ID NO: 435047 - DNA, 340 bp, Homo sapiens
cctgggtgctaactggcctctacctttgtctctgtctcctctgcctctgctcttggttagctgacggtagggaaagtgtccagcggaataggggctgcagctgaagtcctggtcaatctgtacatgaatgatcacagacctaaggcccaggccacctctccagacctggtaaggacatgcacccccagccttcacccacagacactggctctggcatcccagggcgggcacatgggatgtcgagaggatgccctggccctcccgaggctcctcttctcttggaacaagagggggctgagaatgagctgaatcagggcagaagttaaaaggagcctgcttt

SEQ ID NO: 435048 - DNA, 439 bp, Homo sapiens
cctgttcactcttgctgccccaagccggaggaggccacacccagcccatcacctcctctgaaaaggcaggtagggctccttccagtggatgctgttttggtgaagccagaggggactttgatccagatgggtggggtcagtggctcttcccacaccccaagtagggctgattgtagattttctggacacaccttgatgtcaccacacttataggtaagaataaccaagtatgcaacatcacaaaatacattttattgatcccttagccagtcagaggtatcaattgaccaaataccatgctctcgatggtgctgctagggaaaaataaactgtaccacagggtattttgtatgatgccctataacactaagcattatctgcagaccattcaaataggctgatttccatatcaatgaaaaagtgatgttggaatgggccc

SEQ ID NO: 435049 - DNA, 5855 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccaggtatctccacctccttctttaggaaggtgctgggctggcccctcaggctgccgagggacctgtgtaactggatgcagggactcctgcaagctgctggcctccatatcagggacaatgcttacaactactgctacatgtacgagctcctgagcctggggctgccactcctctgggcgttctctgaggtcctggcagccatgtacagggaatctgagggctccctcgagagcatctgcaactgggtgctcaggtgcttcccagtcaagctccgctgacatggctggctgccccaaagtgccttcacatttccagggaggcttcagatggcagtgcgtttgcagtttgctcaggctctggccaggaagcctagcattctctaagcaattagctcaaagccaaagaatttcacatgggccacctccgcctggccttatcagggtgaacatctactcacggtgctagggccagggatgatatgaaggatcttttctatagctttgtgagccatacttctgggtttacatttcaatttttttaattttaattagcccagagaaagcatttttttctatgagtgtcaatttttctaaacatgggtttgaagcttataaccagttttataaaccccttgaacactgcagtgagttatcaaagccactgcctgcaaagtggatgatttaagattttacacgcatgaaaatgagtgtgccatctcctgaccagtgccttttgacttaggtacccagatgccacttgtcagcagcaggatactttttacaacacgaaagcataattattttagaagaagagagtagaagggcagaatagaattcaacttacagaagcacggagtagtgtgtggttggctgttatctgtccccctgggaggaggactgttttgctcccttgttttgatgttaaacagtagcttaaaggctttcccccccataccaactcacagccaaatgacaaagaaccgtggggtttcaacagattctacaaacatgcattttcccttcccactaatgggcactgcagggaaagcccattggcatttgaccatggagctgatgcagtgccaaagatgagctctttcaactgatggcattttagcccctgtggctcccagcggatcccccagcccgggctgcaggctgagccaaggctgtgcagggtccatattggtcaggccaagtggagtggaagactctgtccacttatgtggtgtcctttgggactgagggggtttgttagcacatcaggctattgctgggaagcgtggcctgcccagtgagcattgcctgtggacatcctgactgcttagctgctccgctgccacacatatgtggtcaaaacagaaaccaatttcacactgccctgggaaaggaatgggtctgacctccaggggaagctctaccatatcttgactggcagggaaggctgggagtggaagctatttatggactgatccaaaggacatatgcatgagtaagggtaaaaatgagcatgcaggtccacctgtgttcttactctgggtatctagaagagtcctcagctctccctactccacgctgcctagacatacacagctgcagggtctggctgaacaatcaaggggccgccagagaaaggccatctacggtgcgcagtgtatctggagttgctgggcccaagatagctctgtggagttatcactagagatgcctctggattaactaagaggtgtgcctgggtgtgggtgaggagtcagaacctttgagagctttgagatgacagtttctatggggcgggaagaaggaggtgcatttctacaaacacttccctgaaatccttgggaaaaacagaggcatggccgtggccaactctgtgggaactggcgcctctgtccttgttggcactgttctcagtccgatgacttgcattgtgttttctccaatttttgctgggattttaatgttcagcatggtgggaggaacccttgattccttttgtttgatgtatttgtgcagatcctggccagtacaaagtcgttgctcttgtcttatcttctcttacagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaagcaaaaaaagta

SEQ ID NO: 435050 - DNA, 3198 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaaggtagttgtcctgaacaatttgctttccctattccctgcatgttcccagatgttctcatgctccacttgacctgcacaaacatcttgagcctggcttggctggaataaaaatttgtaagatatttt

SEQ ID NO: 435051 - DNA, 1174 bp, Homo sapiens
aggcgctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaagtacagtataattttctttttctgcctagaaagcagatactacaaaatagaaattccacttgctgcttccaaagggtgtttctgtaggagttattcttactgggagctggttggcataatgccactgaagggtattttactgttttttttttaccattgctatgactttaggtttgctgtttggctccaaggggatttatgattaagccattaaacctgtaatttggttaccctgtcccaaggggttgctactttggcaaaggaaatctaatcaataaataggacagaagacatag

SEQ ID NO: 435052 - DNA, 353 bp, Homo sapiens
ctgtgatgctagaggttaccaagagtctctctcctctctcacctctgcagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcgtggcctgggagccaagaagttctatgggaagttctgtgctggctccatcgaccatatcagtgagtggagtctatggtgatatcccatgaagggaggggactgaccctgggtgggacatatctctccaggtctaggagtccccagcttgttccat

SEQ ID NO: 435053 - DNA, 1997 bp, Homo sapiens
ggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctcttt

SEQ ID NO: 435054 - DNA, 1908 bp, Homo sapiens
ggctcctggtctccccgccgctccccgggggaggggagcggcttggtgcgcctgcgccagcctgtggctttctgggaatcaaagttccggaggttcatgcggtcccttttccgctgttcccggacggactacaaaacccttgatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctcttt

SEQ ID NO: 435055 - DNA, 1700 bp, Homo sapiens
ggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatatta

SEQ ID NO: 435056 - DNA, 2138 bp, Homo sapiens
  misc_feature (1775)..(1775): n is a, c, g, or t
  misc_feature (1792)..(1792): n is a, c, g, or t
  misc_feature (1798)..(1798): n is a, c, g, or t
  misc_feature (1814)..(1814): n is a, c, g, or t
  misc_feature (1825)..(1825): n is a, c, g, or t
  misc_feature (1829)..(1829): n is a, c, g, or t
  misc_feature (1832)..(1832): n is a, c, g, or t
  misc_feature (1835)..(1835): n is a, c, g, or t
  misc_feature (1837)..(1838): n is a, c, g, or t
  misc_feature (1843)..(1843): n is a, c, g, or t
  misc_feature (1846)..(1847): n is a, c, g, or t
  misc_feature (1852)..(1852): n is a, c, g, or t
  misc_feature (1861)..(1861): n is a, c, g, or t
  misc_feature (1870)..(1870): n is a, c, g, or t
  misc_feature (1873)..(1873): n is a, c, g, or t
  misc_feature (1882)..(1884): n is a, c, g, or t
  misc_feature (1889)..(1889): n is a, c, g, or t
  misc_feature (1892)..(1892): n is a, c, g, or t
  misc_feature (1895)..(1895): n is a, c, g, or t
  misc_feature (1898)..(1899): n is a, c, g, or t
  misc_feature (1905)..(1905): n is a, c, g, or t
  misc_feature (1918)..(1918): n is a, c, g, or t
  misc_feature (1921)..(1921): n is a, c, g, or t
  misc_feature (1925)..(1925): n is a, c, g, or t
  misc_feature (1929)..(1929): n is a, c, g, or t
  misc_feature (1934)..(1934): n is a, c, g, or t
  misc_feature (1940)..(1940): n is a, c, g, or t
  misc_feature (1947)..(1947): n is a, c, g, or t
  misc_feature (1949)..(1949): n is a, c, g, or t
  misc_feature (1955)..(1955): n is a, c, g, or t
  misc_feature (1957)..(1957): n is a, c, g, or t
  misc_feature (1961)..(1961): n is a, c, g, or t
  misc_feature (1971)..(1972): n is a, c, g, or t
  misc_feature (1982)..(1982): n is a, c, g, or t
  misc_feature (1987)..(1987): n is a, c, g, or t
  misc_feature (2014)..(2014): n is a, c, g, or t
  misc_feature (2017)..(2018): n is a, c, g, or t
  misc_feature (2021)..(2021): n is a, c, g, or t
ggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattaaaaaaaaaaaaaaaaaaaaaaaaaanaaaaaaaaaaaaaaaanaaaaanaaaaaaaaaaaaaaanaaaaaaaaaanaaanaanaanannaaaanaannaaccntggggcccncttggcccnagncatttttannntgggnaanttnttnnttgcgnccgaatttggggntanttgnccanattcnccttanggggggngntttaanantaangggcccgggnnttaaaacggngggantgggaaaaccctggggttcccaaattnaanngcnttggagaatatcccctttccccgtttgggtaataagaaaaggccccaccggtgccccttccaacagttcccccccttattggaatggaattggagggttaatttttgttaaatccgg

SEQ ID NO: 435057 - DNA, 939 bp, Homo sapiens
gcggccgctccaacatcaggagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatatta

SEQ ID NO: 435058 - DNA, 1430 bp, Homo sapiens
ggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagcaaggcgccacacaaagggccctcaacgcgcctcacaatgagccccacaacgagccggtaccgag

SEQ ID NO: 435059 - DNA, 1186 bp, Homo sapiens
ggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatcgctccatgagcgaatcgtttcgcgcaggatctctagacgacgacacttt

SEQ ID NO: 435060 - DNA, 711 bp, Homo sapiens
  misc_feature (572)..(572): n is a, c, g, or t
  misc_feature (704)..(704): n is a, c, g, or t
ggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgagcaatancccctaaggaggtggcacacttaacagccagatgagatccactcagtaagcgagatcgtgatatggcgagacatatttagataggtatctaggactataatgtctttgacccttgagcgccatattagtcanctttgtg

SEQ ID NO: 435061 - DNA, 507 bp, Homo sapiens
gtgaggtgtcagacttgagggtagaggtaacacggactggtcaagaggacatgctgatgggaattggggtggggagaagtttttggagtacagtgggatttagtggttgaggtaggacattttggggtaaatccagtcactccttttcaagctgggtttgtggaggggctgagatgacactggggttctgctgaccctggtctcttcccccttttaaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgt

SEQ ID NO: 435062 - DNA, 1749 bp, Homo sapiens
ggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatatta

SEQ ID NO: 435063 - DNA, 1869 bp, Homo sapiens
ggcatcggcggcagcagcggtggctgctgtggagagagagagagagtggctggttggggggaaggggccagagttgaggggtccatagcctagtaactgggtgatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctcttt

SEQ ID NO: 435064 - DNA, 2089 bp, Homo sapiens
  misc_feature (1775)..(1775): n is a, c, g, or t
  misc_feature (1792)..(1792): n is a, c, g, or t
  misc_feature (1798)..(1798): n is a, c, g, or t
  misc_feature (1814)..(1814): n is a, c, g, or t
  misc_feature (1825)..(1825): n is a, c, g, or t
  misc_feature (1829)..(1829): n is a, c, g, or t
  misc_feature (1832)..(1832): n is a, c, g, or t
  misc_feature (1835)..(1835): n is a, c, g, or t
  misc_feature (1837)..(1838): n is a, c, g, or t
  misc_feature (1843)..(1843): n is a, c, g, or t
  misc_feature (1846)..(1847): n is a, c, g, or t
  misc_feature (1852)..(1852): n is a, c, g, or t
  misc_feature (1861)..(1861): n is a, c, g, or t
  misc_feature (1870)..(1870): n is a, c, g, or t
  misc_feature (1873)..(1873): n is a, c, g, or t
  misc_feature (1882)..(1884): n is a, c, g, or t
  misc_feature (1889)..(1889): n is a, c, g, or t
  misc_feature (1892)..(1892): n is a, c, g, or t
  misc_feature (1895)..(1895): n is a, c, g, or t
  misc_feature (1898)..(1899): n is a, c, g, or t
  misc_feature (1905)..(1905): n is a, c, g, or t
  misc_feature (1918)..(1918): n is a, c, g, or t
  misc_feature (1921)..(1921): n is a, c, g, or t
  misc_feature (1925)..(1925): n is a, c, g, or t
  misc_feature (1929)..(1929): n is a, c, g, or t
  misc_feature (1934)..(1934): n is a, c, g, or t
  misc_feature (1940)..(1940): n is a, c, g, or t
  misc_feature (1947)..(1947): n is a, c, g, or t
  misc_feature (1949)..(1949): n is a, c, g, or t
  misc_feature (1955)..(1955): n is a, c, g, or t
  misc_feature (1957)..(1957): n is a, c, g, or t
  misc_feature (1961)..(1961): n is a, c, g, or t
  misc_feature (1971)..(1972): n is a, c, g, or t
  misc_feature (1982)..(1982): n is a, c, g, or t
  misc_feature (1987)..(1987): n is a, c, g, or t
  misc_feature (2014)..(2014): n is a, c, g, or t
  misc_feature (2017)..(2018): n is a, c, g, or t
  misc_feature (2021)..(2021): n is a, c, g, or t
ggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattaaaaaaaaaaaaaaaaaaaaaaaaaanaaaaaaaaaaaaaaaanaaaaanaaaaaaaaaaaaaaanaaaaaaaaaanaaanaanaanannaaaanaannaaccntggggcccncttggcccnagncatttttannntgggnaanttnttnnttgcgnccgaatttggggntanttgnccanattcnccttanggggggngntttaanantaangggcccgggnnttaaaacggngggantgggaaaaccctggggttcccaaattnaanngcnttggaagaacctccccttttccgcagggggcgtagccatgggaaatttaagcggtaatattttgttaa

SEQ ID NO: 435065 - DNA, 1710 bp, Homo sapiens
ggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatatta

SEQ ID NO: 435066 - DNA, 597 bp, Homo sapiens
catcatgggtttccctggacgagcacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatatta

SEQ ID NO: 435067 - DNA, 825 bp, Homo sapiens
ccgccttttcctgccctggatctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctggtaagtccatgaatattttataagcatatactcttttcagtgggttggggaacaagatcttaaagctggagccatgtggtttactcacactgatggtgacttttttcgtgtatagggacacaaaattctactcacctaaatgaaacaatttcatctgttttttagattgaagggaattgtgcaaacttagatgatccaggttttgtgaaagtgaacacatcacttttgtgctaaggaaataattgttgctatggaagtattggggggaggttctagcggaggagttatctctaattttttttttc

SEQ ID NO: 435068 - DNA, 10007 bp, Homo sapiens
  misc_feature (1651)..(1651): n is a, c, g, or t
  misc_feature (3573)..(3573): n is a, c, g, or t
ccgccttttcctgccctggatctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcnctcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgnctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgtgtgcatttttaaattgagagagaacagcaaagccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaatatttgagaaaaggcctgtattgcataaataaattctttgtatgttgtga

SEQ ID NO: 435069 - DNA, 9478 bp, Homo sapiens
  misc_feature (1651)..(1651): n is a, c, g, or t
  misc_feature (3573)..(3573): n is a, c, g, or t
ccgccttttcctgccctggatctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcnctcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgnctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaataagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaatatttgagaaaaggcctgtattgcataaataaattctttgtatgttgtga

SEQ ID NO: 435070 - DNA, 9651 bp, Homo sapiens
  misc_feature (1651)..(1651): n is a, c, g, or t
  misc_feature (3573)..(3573): n is a, c, g, or t
ccgccttttcctgccctggatctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcnctcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgnctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaataagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaactttgatctctatttctcttgcaacagacttcaagtggtccctctttttttcctacacactcagctcttctctaaaagcaaggatttggaatgaacaattcagtttgacagaaaaagctgaataaaatggcatctgtaattgaattgttggaaatgcctgttttgctcctaaattttaaacatcatcattaataaaataatgattcacaaagaaagaaaaaaaaaa

SEQ ID NO: 435071 - DNA, 9669 bp, Homo sapiens
  misc_feature (1651)..(1651): n is a, c, g, or t
  misc_feature (3573)..(3573): n is a, c, g, or t
ccgccttttcctgccctggatctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcnctcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgnctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaataagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaactttgatctctatttctcttgcaacagacttcaagtggtccctctttttttcctacacactcagctcttctctaaaagcaaggatttggaatgaacaattcagtttgacagaaaaagctgaataaaatggcatctgtaattgaattgttggaaatgcctgttttgctcctaaattttaaacatcaggtgttgctgaatacagcacccggtagcctctatttgcaacccggggagtgcagtatct

SEQ ID NO: 435072 - DNA, 9934 bp, Homo sapiens
  misc_feature (1651)..(1651): n is a, c, g, or t
  misc_feature (3573)..(3573): n is a, c, g, or t
ccgccttttcctgccctggatctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcnctcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgnctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatgggccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaatatttgagaaaaggcctgtattgcataaataaattctttgtatgttgtga

SEQ ID NO: 435073 - DNA, 3648 bp, Homo sapiens
cgagctcggcacccgaagatcatcgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaataagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaatatttgagaaaaggcctgtattgcataaataaattctttgtatgttgtga

SEQ ID NO: 435074 - DNA, 2916 bp, Homo sapiens
agcggagaaaaatggtgcccagatagcacagagggaatgtgagggaaagcggagaaaattaaggagataatgatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaataagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaatatttgagaaaaggcctgtattgcataaataaattctttgtatgttgtga

SEQ ID NO: 435075 - DNA, 9822 bp, Homo sapiens
  misc_feature (1651)..(1651): n is a, c, g, or t
  misc_feature (3573)..(3573): n is a, c, g, or t
ccgccttttcctgccctggatctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcnctcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgnctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaatatttgagaaaaggcctgtattgcataaataaattctttgtatgttgtga

SEQ ID NO: 435076 - DNA, 9449 bp, Homo sapiens
  misc_feature (1651)..(1651): n is a, c, g, or t
  misc_feature (3573)..(3573): n is a, c, g, or t
ccgccttttcctgccctggatctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcnctcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgnctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaataagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaacctttggcttcgttggcttcagcggtggagcttctcggccct

SEQ ID NO: 435077 - DNA, 9450 bp, Homo sapiens
  misc_feature (1651)..(1651): n is a, c, g, or t
  misc_feature (3573)..(3573): n is a, c, g, or t
  misc_feature (9444)..(9444): n is a, c, g, or t
  misc_feature (9450)..(9450): n is a, c, g, or t
ccgccttttcctgccctggatctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcnctcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgnctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaataagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaaatcatggcctcgttggactcagcggtggaggtctgcngcaagn

SEQ ID NO: 435078 - DNA, 2331 bp, Homo sapiens
cgaggcgatctagaggatccctagctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaatatttgagaaaaggcctgtattgcataaataaattctttgtatgttgtga

SEQ ID NO: 435079 - DNA, 2346 bp, Homo sapiens
ctcagattggagagtagacggatagcatggggacttgtgctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaatatttgagaaaaggcctgtattgcataaataaattctttgtatgttgtga

SEQ ID NO: 435080 - DNA, 2070 bp, Homo sapiens
ctgcaaaacctctcttcaattataaaataactcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaatatttgagaaaaggcctgtattgcataaataaattctttgtatgttgtga

SEQ ID NO: 435081 - DNA, 1357 bp, Homo sapiens
agccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaatatttgagaaaaggcctgtattgcataaataaattctttgtatgttgtga

SEQ ID NO: 435082 - DNA, 874 bp, Homo sapiens
gaagaacatttcccatgcatctacataatattatagctggaataagtggtttacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaatatttgagaaaaggcctgtattgcataaataaattctttgtatgttgtga

SEQ ID NO: 435083 - DNA, 582 bp, Homo sapiens
tctggtccgatatataaattaatcagacataaaaacagagtcaaagatcctgtttttaaaagatatattacacagaaaaaccccacaaaatttagaaaagaaaggaaacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaactttgatctctatttctcttgcaacagacttcaagtggtccctctttttttcctacacactcagctcttctctaaaagcaaggatttggaatgaacaattcagtttgacagaaaaagctgaataaaatggcatctgtaattgaattgttggaaatgcctgttttgctcctaaattttaaacatcatcattaataaaataatgattcacaaagaaagaaaaaaaaaa

SEQ ID NO: 435084 - DNA, 577 bp, Homo sapiens
gaggaagaatgtgagtagttattgttaatctaatgtttaggaacatgctatagtgatattgaggatactaatgcttttaatgtgttttttttttttccttgtaagttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcaggtatgattttttctatagtacaatatatgcaaagaaataaagtttgattttcaaatacatatttttcttattccatttagcaatatttaagaaatatttgagcatgtagcatgcacctagaactttagtgtccaagcccttaaataagcacagtttattttaaatattcgagaaatataactagctgagttattttatcgttttcttttgtttccagatcttttggttgacatgttggga

SEQ ID NO: 435085 - DNA, 356 bp, Homo sapiens
tggtagttttgaagccagctttgaactaactatagtgtaccttatttgatcatgtgattaaatgtgcactattaatagtctgaaaaaataatttgaagaaacagtttggatgaaattgtaacaaatcctcatttgttttctttataacttcttttttaaaattctctttaaaataggtctggtttgcatgaagtcgagtagttcagttgtggaattggttatgctactgtgttctcaggtgagtggcaagaataaatgttgaattaaaagtagattatcacatgaatttgttttcatgggggattttatatttgcattactgaaatttttggtataataaaattgtgagtttgctg

SEQ ID NO: 435086 - DNA, 1598 bp, Homo sapiens
agagacagagagaagaagaaatatttccaaatataccaggctgatctttcgtagtttctcagtcttgctgtctgttgtcgtttgaaatctgtttcccacgagactctgggaagatggaggtgcagggcttgggtaacagctgccttcctcagggctgggtacctgctctccgagtctgtgtctccaggctgtgtgctcagacttgaccatgtttgggcatggaggcttgccccagatggggaccaaaagctgcttccctggagacgggcggggaggccaaacttcctgctgaagctctgtggcctcttttggggtgggggcgggggtccaggcagaaagaaactgtctgctgctcaagacccacaggacgccgggaagactaaatgatcactgcccccagtgaatatggtgaagaagctggtgatggcccagaagcggggagagacacgagccctttgcctgggtgtaaccatggtggtgtgtgccgtcatcacctactacatcctggtcacgactgtgctgcccctctaccagaaaagcgtgtggacccaggaatccaagtgccacctgattgagaccaacatcagggaccaggaggagctgaagggcaagaaggtgccccagtacccatgcctgtgggtcaacgtgtcagctgccggcaggtgggctgtgctgtaccacacggaggacactcgggaccagaaccagcagtgctcctacatcccaggcagcgtggacaattaccagacggcccgggccgacgtggagaaggtcagagccaaattccaagagcagcaggtcttctactgcttctccgcacctcgggggaacgaaaccagcgtcctattccagcgcctctacgggccccaggccctcctcttctccctcttctggcccaccttcctgctgaccggtggcctcctcattatcgccatggtgaagagcaaccagtacctgtccatcctggcggcccagaagtagagccatccatccatgccataccacttgtcagggcacaggggactggctgggcccccagggctgctccccacttgcagcacaatgccttctccacctgccctcccactcttccagtccaatccacgctgtcttctgttgcaggactaacctttgagaaatccttttgtgaagtcattgcctgctcaagaatgtacagtggctccccaatgccttggaggccataaggccagccagttctagctctctattacctgtccccactcaactgactcatacctgtttccggctgcatcactatgtgccccacagagaacgatgatcgtcacctctgtgcctgagttctccctgttgtctcaaagcggtacccatcctcccccagaagctgtccccagcgagcctcccttctttgtttgaattctctaataagagcaacagcagctcccatttctagaacacatttacagtattactattttctaggatataaagtgccatatatatttttaattccaatattaataaatgtatgccaaacaacaaaaaaaacagctgcaaggaaacacatgagaactcatcaaaattttagcggtgggatggtggttaatttctgttttctt

SEQ ID NO: 435087 - DNA, 1520 bp, Homo sapiens
agagacagagagaagaagaaatatttccaaatataccaggctgatctttcgtagtttctcagtcttgctgtctgttgtcgtttgaaatctgtttcccacgagactctgggaagatggaggtgcagggcttgggtaacagctgccttcctcagggctgggtacctgctctccgagtctgtgtctccaggctgtgtgctcagacttgaccatgtttgggcatggaggcttgccccagatggggaccaaaagctgcttccctggagacgggcggggaggccaaacttcctgctgaagctctgtggcctcttttggggtgggggcgggggtccaggcagaaagaaactgtctgctgctcaagacccacaggacgccgggaagactaaatgatcactgcccccagtgaatatggtgaagaagctggtgatggcccagaagcggggagagacacgagccctttgcctgggtgtaaccatggtggtgtgtgccgtcatcacctactacatcctggtcacgactgtgctgcccctctaccagaaaagcgtgtggacccaggaatccaagtgccacctgattgagaccaacatcagggaccaggaggagctgaagggcaagaaggtgccccagtacccatgcctgtgggtcaacgtgtcagctgccggcaggtgggctgtgctgtaccacacggaggacactcgggaccagaaccagcagtgctcctacatcccaggcagcgtggacaattaccagacggcccgggccgacgtggagaaggtcagagccaaattccaagagcagcaggtcttctactgcttctccgcacctcgggggaacgaaaccagcgtcctattccagcgcctctacgggccccaggccctcctcttctccctcttctggcccaccttcctgctgaccggtggcctcctcattatcgccatggtgaagagcaaccagtacctgtccatcctggcggcccagaagtagagccatccatccatgccataccacttgtcagggcacaggggactggctgggcccccagggctgctccccacttgcagcacaatgccttctccacctgccctcccactcttccagtccaatccacgctgtcttctgttgcaggactaacctttgagaaatccttttgtgaagtcattgcctgctcaagaatgtacagtggctccccaatgccttggaggccataaggccagccagttctagctctctattacctgtccccactcaactgactcatacctgtttccggctgcatcactatgtgccccacagagaacgatgatcgtcacctctgtgcctgagttctccctgttgtctcaaagcggtacccatcctcccccagaagctgtccccagcgagcctcccttctttgtttgaattctctaataagagcaacagcagctcccatttctagaacacatttacagtattactattttctaggatataaagtgccatatatatttttaattccaatattaataaatgtatgccaaacaaca

SEQ ID NO: 435088 - DNA, 1001 bp, Homo sapiens
agagacagagagaagaagaaatatttccaaatataccaggctgatctttcgtagtttctcagtcttgctgtctgttgtcgtttgaaatctgtttcccacgagactctgggaagatggaggtgcagggcttgggtaacagctgccttcctcagggctgggtacctgctctccgagtctgtgtctccaggctgtgtgctcagacttgaccatgtttgggcatggaggcttgccccagatggggaccaaaagctgcttccctggagacgggcggggaggccaaacttcctgctgaagctctgtggcctcttttggggtgggggcgggggtccaggcagaaagaaactgtctgctgctcaagacccacaggacgccgggaagactaaatgatcactgcccccagtgaatatggtgaagaagctggtgatggcccagaagcggggagagacacgagccctttgcctgggtgtaaccatggtggtgtgtgccgtcatcacctactacatcctggtcacgactgtgctgcccctctaccagaaaagcgtgtggacccaggaatccaagtgccacctgattgagtccaatccacgctgtcttctgttgcaggactaacctttgagaaatccttttgtgaagtcattgcctgctcaagaatgtacagtggctccccaatgccttggaggccataaggccagccagttctagctctctattacctgtccccactcaactgactcatacctgtttccggctgcatcactatgtgccccacagagaacgatgatcgtcacctctgtgcctgagttctccctgttgtctcaaagcggtacccatcctcccccagaagctgtccccagcgagcctcccttctttgtttgaattctctaataagagcaacagcagctcccatttctagaacacatttacagtattactattttctaggatataaagtgccatatatatttttaattccaatattaataaatgtatgccaaacaaca

SEQ ID NO: 435089 - DNA, 907 bp, Homo sapiens
agagacagagagaagaagaaatatttccaaatataccaggctgatctttcgtagtttctcagtcttgctgtctgttgtcgtttgaaatctgtttcccacgagactctgggaagatggaggtgcagggcttgggtaacagctgccttcctcagggctgggtacctgctctccgagtctgtgtctccaggctgtgtgctcagacttgaccatgtttgggcatggaggcttgccccagatggggaccaaaagctgcttccctggagacgggcggggaggccaaacttcctgctgaagctctgtggcctcttttggggtgggggcgggggtccaggcagaaagaaactgtctgctgctcaagacccacaggacgccgggaagactaaatgatcactgcccccagtgaatatggtgaagaagctggtgatggcccagaagcggggagagacacgagccctttgcctgggtgtaaccatggtggtgtgtgccgtcatcacctactacatcctggtcacgactgtgctgcccctctaccagaaaagcgtgtggacccaggaatccaagtgccacctgattgagaccaacatcagggaccaggaggagctgaagggcaagaaggtgccccagtacccatgcctgtgggtcaacgtgtcagctgccggcaggtgggctgtgctgtaccacacggaggacactcgggaccagaaccagcagtgctcctacatcccaggcagcgtggacaattaccagacggcccgggccgacgtggagaaggtcagagccaaattccaagagcagcctgggggcccagccagtcccctgtgccctgacaagtggtatggcatggatggatggctctcttctgggccgccaggatgtacaggtactggtgctctcaccatacgatagt

SEQ ID NO: 435090 - DNA, 2243 bp, Homo sapiens
cgcggcagaaggagcgaagctctggcccggcgtgtagcgggcgcactacggggacgctgggccgggcaccgggctgtgtggagaagtgagcgcgctcgtctgacccccgtgcccgccaccccgagccactaacggcgatctcccaaggcctgcccgaggcctctgtcctctgtcctcagccccgcagcggcaacgtcttgcactcggcgagctcgccgctcccgaccctcccgcgcccccgccctgccgcgctgctccccgcccagccgcgggtctgtggtccaagccgccccgaagcagcccgaacaagatcactcaaggtgaaggataatctactaataccagcactttgaatgaaaatttgtttctctgccacaaactgaacatcttttttttttttttttttttttggtgggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaagtcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaattttttttttttaagcttatagtaaggatacattcaagcttgggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaa

SEQ ID NO: 435091 - DNA, 1827 bp, Homo sapiens
cggacgcgtgggtcgacccacgcgtccgcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaagtcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaattttttttttttaagcttatagtaaggatacattcaagcttgggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaa

SEQ ID NO: 435092 - DNA, 1639 bp, Homo sapiens
acagagttccccattggatgctgaggcaggagtttgagatagcctgggcaacatagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaagtcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaattttttttttttaagcttatagtaaggatacattcaagcttgggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaa

SEQ ID NO: 435093 - DNA, 2189 bp, Homo sapiens
cgcggcagaaggagcgaagctctggcccggcgtgtagcgggcgcactacggggacgctgggccgggcaccgggctgtgtggagaagtgagcgcgctcgtctgacccccgtgcccgccaccccgagccactaacggcgatctcccaaggcctgcccgaggcctctgtcctctgtcctcagccccgcagcggcaacgtcttgcactcggcgagctcgccgctcccgaccctcccgcgcccccgccctgccgcgctgctccccgcccagccgcgggtctgtggtccaagccgccccgaagcagcccgaacaagatcactcaaggtgaaggataatctactaataccagcactttgaatgaaaatttgtttctctgccacaaactgaacatcttttttttttttttttttttttggtgggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagggtcaaggtagtagtaccaatggaatgttcccaggtgacagcccccttaacctcagtcctctccagtacagtaatgcctttgatgtgtttgcagcctatggaggcctcaatgagaagtcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaattttttttttttaagcttatagtaaggatacattcaagcttgggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaa

SEQ ID NO: 435094 - DNA, 2174 bp, Homo sapiens
cgcggcagaaggagcgaagctctggcccggcgtgtagcgggcgcactacggggacgctgggccgggcaccgggctgtgtggagaagtgagcgcgctcgtctgacccccgtgcccgccaccccgagccactaacggcgatctcccaaggcctgcccgaggcctctgtcctctgtcctcagccccgcagcggcaacgtcttgcactcggcgagctcgccgctcccgaccctcccgcgcccccgccctgccgcgctgctccccgcccagccgcgggtctgtggtccaagccgccccgaagcagcccgaacaagatcactcaaggtgaaggataatctactaataccagcactttgaatgaaaatttgtttctctgccacaaactgaacatcttttttttttttttttttttttggtgggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactcgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaagtcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaattttttttttttaagcttatagtaaggatacattcaagcttgggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaa

SEQ ID NO: 435095 - DNA, 1918 bp, Homo sapiens
cgcggcagaaggagcgaagctctggcccggcgtgtagcgggcgcactacggggacgctgggccgggcaccgggctgtgtggagaagtgagcgcgctcgtctgacccccgtgcccgccaccccgagccactaacggcgatctcccaaggcctgcccgaggcctctgtcctctgtcctcagccccgcagcggcaacgtcttgcactcggcgagctcgccgctcccgaccctcccgcgcccccgccctgccgcgctgctccccgcccagccgcgggtctgtggtccaagccgccccgaagcagcccgaacaagatcactcaaggtgaaggataatctactaataccagcactttgaatgaaaatttgtttctctgccacaaactgaacatcttttttttttttttttttttttggtgggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctttgaattttagcttaaataacatgcagtattctaaccagcaattccagcctgttatggctaactaaaaaaaagaaaatgtatcgtacaagttaaaatgcacgggcccaagggggattttttttttcacctccttgagaattttttttttttaagcttatagtaaggatacattcaagcttgggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaa

SEQ ID NO: 435096 - DNA, 1710 bp, Homo sapiens
cgcggcagaaggagcgaagctctggcccggcgtgtagcgggcgcactacggggacgctgggccgggcaccgggctgtgtggagaagtgagcgcgctcgtctgacccccgtgcccgccaccccgagccactaacggcgatctcccaaggcctgcccgaggcctctgtcctctgtcctcagccccgcagcggcaacgtcttgcactcggcgagctcgccgctcccgaccctcccgcgcccccgccctgccgcgctgctccccgcccagccgcgggtctgtggtccaagccgccccgaagcagccccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctttgaattttagcttaaataacatgcagtattctaaccagcaattccagcctgttatggctaactaaaaaaaagaaaatgtatcgtacaagttaaaatgcacgggcccaagggggattttttttttcacctccttgagaattttttttttttaagcttatagtaaggatacattcaagcttgggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaa

SEQ ID NO: 435097 - DNA, 515 bp, Homo sapiens
cggacgcgtgggtcgacccacgcgtccgaaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaa

SEQ ID NO: 435098 - DNA, 527 bp, Homo sapiens
ttttttttttttgagaattgctaaatggaaagctagcctagaagcaccaagtaaatatattcaaggaatataagttgtttaaacattagaaaaatttttgcactcattttttagctgtattaggaatgtcaataatcctgtagcaaattttcacagagaactttaagaaattcttgcattggtcgatttcaatttgaaagctttttggtttgtttgctttttaaattttcatgttctaggaaactatgattctggttgttcaggattgttattattatagttgtgtaaaattattttattttgtgtgtattgtgcacagcttgggggggggcgggaaatgcactaattgtgctcttccttataaatggtacatattactgacacagacaaataaagtttctaattgtttctgatttaatcactagtgatacagcatattctgtatgaaatgttttctcctttctcattgtcatctacttcattttttgttttcatgttttgaagaaataaaaaccaaaatggtatta

SEQ ID NO: 435099 - DNA, 1178 bp, Homo sapiens
ctctgctcactgcaagctccgcctcctgagttcatgccattctcctgcttcagccttctgagtagctgggacaacaggtgtccgccaccatgcccaattaatttttttgtatttgtagagatggggtttcaccgtgttagctaggatggtctcgatctcctgaccttgtgatccgcccgccttggcctcccaaagtgctgggattacaggcgtgagctaccgtgcccggctattaataatgttaacaataactaatgattattgagcatttactacatgtcaggtcctgaattatgtatattatttcatttactcctcataaaagggttccttctaggagctaggggagaaaaccagccattatatagtcaataataatattaatggtaataatagttattatatataacagttatatattacataacatatgctggccctgaattgaacatattctctaatttgatttttgaatatttaaaaatatacacatatatttgttttttttttttaagagatggaggagtctcaccatgttgcccaagctggcctcaaacccctggcctcaagtgagcctcccacctcagcctcccaagtagctgccaccatgcagtctctaatttaaattttaaacaaaccctagatgttattattatcttagagtaggctgcttctaaaatagctcccaatgatcctcttgctggtctttacatccttgtgtaatctccttgagtgtgggctggacctaatgacttacttctaactcacaggatgtggcaacagtgatgggatgtcacatctgtgattggattacgaaagactgtgccttctgttttgctattactgtctctggtgagtcctctctcttgctcttgcttgcttgcactgatgaagtaagctgccacgttgtgagatgctcaacgaagaggcccatgaggcagggcaccgagggaggcttctggccaacagctcctggggaaccaaggccttaggaagtgagtcctgccaaccttgttccagcgtggaaagcagcgtggcacttcccggtggtgaaagcaccccagcttgaaagggtgaaaacaccttctcccagatagtctccctttgtttagccagtgcttttgccttaaggaaatcaaatgaaggtatgctccttggttggctgctgaatctgtcct

SEQ ID NO: 435100 - DNA, 3501 bp, Homo sapiens
ggtgggcctgttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435101 - DNA, 3645 bp, Homo sapiens
ggtgggcctgttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435102 - DNA, 2329 bp, Homo sapiens
tgtattggtggtgctccgtctagacagtgcttcagtgtggctgacacagcagcatggtcttgacaagttttcttcatcctaccacaaaatcccagttggtaatagagactttactcctacctatcaaaaccacaaaatgtcccattagggggggacatgttgtacatgttaggatcattcaaataaccaagattataaggtgaggaaagatgcccctaactgattcttttgtctctcatcttgttggttccagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435103 - DNA, 3612 bp, Homo sapiens
ggtgggcctgttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435104 - DNA, 3468 bp, Homo sapiens
ggtgggcctgttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435105 - DNA, 1908 bp, Homo sapiens
tctgtgttaactctgagagaacaaataatggctttttaaagactgttaatagaataatgaagacttactgtgtttttaacgtgaaaattttaggtgaccaagggtcctgctataacatactgggggtcataggatagtagaatggtcaacatctcaatttagacatgttacttcctgctctaaatacacttgtggacgctacttgtggtgtaactccttatgtatttaataattatctgactctggttttcttggttgatttttttaaatgggtgaagaatctagttatgaattctttgccctttatggaatgtgatatcttggtttttattccatctgttacttcccttttacttaattttatcttattgttttgcgttgtgtttctaaaataatggctttggcttgttttttcctgaatgtttctgcagtttggtttgagtatctgggtttgggcaccactcctgaacttggactccatctgtacttgtgacttttggaaggcagagtcagtgttttctgtggaagatgacatttttttaatattatatatgtgtatctccccctcccctttttggtttctcttaaaagactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaaggtacaatctgttctacagtgtgtatttatggaatgcagtttttcccaacaaggtattattttgaagctaccaggggtaaattttctcataatcaaagagaacccttagcaatataaaaccttataacaaagttgaaaatcttaaaaaccgcttcctttagagtggctagtttaatggcttcaaaaatatttactccattatagtaagctatctgaggaatcagagtgcagttgaagaagctgcagagacatctcttacccccttcctcccatcctgaaatacctttttaattctgatgtatctgatctctttgagaagcaaatgaatcaagtacctgcatcttaaaggaagcagcagaggtcccagggcttaaggctgcaaagcatccacggactatgatgctagcagagagatttaacagtaatactgtttatatgatattattgctgttttttagtgctttctagtcacaaaagtctatagattttgagaggtaagcctataactcttttttctatagccctgttaatttaatttagtgtgtgattttatagagtgtgagttttatttaggtacacatggcatcacagcagaaatgcctgtacaaacattcaagttagttggcagtctataaatgtgagttgggtatattttacaactaaatgatagggcttgaaaatacttttgaattcttgtatataagtagggttaaaaccaacaagacaagcacaaacaattcaagttaactaatagacattaatataattttgaggccaggtatagtggcttacagctgtaatctcaatactttaggaggctgaggaggaaacatcacttgaggccaggagtttgtgaccagactgtgcaacatagactctatcccttaaaaaaaaaaa

SEQ ID NO: 435106 - DNA, 1111 bp, Homo sapiens
gagcaaacagagctttagcacacataattagcttcctcagtgatacagaagtatcctagagtcagtattaagaataaaggccctagcgtcctacacctctgctcactttttcatgttatcatagatcatatgcttagtactggagactttggagaaaaatgagattgatgacattgtcatagtttgttacagagaaaagcactaagcatccactagtgcccagacttgaacccattttcctgacagaattactaaaggctccagaacctaattcagatcacagtcttgagaacacgttggaaggcatacaggttgcaaatgtcttctacaaagatctggctagctgaacatcttggcacaaaaaggacagatcctcaacagtgttataagaagaagaaatgaagaaatttggggatttgtaagggaggaagatgtgccttagtacattaattgttgacattttatactttcccatctgaaaagccaatgaaattgtggccagtaaattttttgaaactggttttgtagccctgccatacagttaattgagccttttcttacataagcaggagatacagtataaagtgccagcttgcatcatactgtcaaatttcaggattattccatttttctgtctggagccattttctgtttgccttgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaaggttggtgccctctgacctgctcagctgttctctttacaaccagtacttttagtacactgctcactaactgtaagttggcatcctgagcttcccaaggcctggtcagacccattaatttctctatttgatgtcttagattcattgatttctccattcgacgatgtctttgtgcccttcctgttttctaagatgtctgtgtttgtcattctgcatgtgcccatctttcaccccattctataaggaatttctgtagtcccaacctactgccttatttcccacttgactgttaaggatcagcata

SEQ ID NO: 435107 - DNA, 791 bp, Homo sapiens
ggtgggcctgttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactggtggtgaatctggacggctcaggcgtcagggccaggtaaggttagcgccatagggggctttacgctcgtgcaccagagggtgtggg

SEQ ID NO: 435108 - DNA, 4847 bp, Homo sapiens
ctctgctcactgcaagctccgcctcctgagttcatgccattctcctgcttcagccttctgagtagctgggacaacaggtgtccgccaccatgcccaattaatttttttgtatttgtagagatggggtttcaccgtgttagctaggatggtctcgatctcctgaccttgtgatccgcccgccttggcctcccaaagtgctgggattacaggcgtgagctaccgtgcccggctattaataatgttaacaataactaatgattattgagcatttactacatgtcaggtcctgaattatgtatattatttcatttactcctcataaaagggttccttctaggagctaggggagaaaaccagccattatatagtcaataataatattaatggtaataatagttattatatataacagttatatattacataacatatgctggccctgaattgaacatattctctaatttgatttttgaatatttaaaaatatacacatatatttgttttttttttttaagagatggaggagtctcaccatgttgcccaagctggcctcaaacccctggcctcaagtgagcctcccacctcagcctcccaagtagctgccaccatgcagtctctaatttaaattttaaacaaaccctagatgttattattatcttagagtaggctgcttctaaaatagctcccaatgatcctcttgctggtctttacatccttgtgtaatctccttgagtgtgggctggacctaatgacttacttctaactcacaggatgtggcaacagtgatgggatgtcacatctgtgattggattacgaaagactgtgccttctgttttgctattactgtctctggtgagtcctctctcttgctcttgcttgcttgcactgatgaagtaagctgccacgttgtgagatgctcaacgaagaggcccatgaggcagggcaccgagggaggcttctggccaacagctcctggggaaccaaggccttaggaagtgagtcctgccaacagccttgaactttgaaaccacagtaccttgttccagcgtggaaagcagcgtggcacttcccggtggtgaaagcaccccagcttgaaagggtgaaaacaccttctcccagatagtctccctttgtttagccagtgcttttgccttaaggaaatcaaatgaaggggtcagccaggagtggatctggaagctggagaactctcaatacgccacttcagtttattgacgacatttataattgcaaccgaagttgactgatttctgctaaatgaaagtttgcgctttgccctttagcattgaggctcctggaaagaacttcaatgaaattggatgcattgagaccaaagaaaagaaggggacatttttatctctctgatacctttctccccagggcttggaaacacttcttaaacacaacctctaatgttggtgttttatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435109 - DNA, 4762 bp, Homo sapiens
ctctgctcactgcaagctccgcctcctgagttcatgccattctcctgcttcagccttctgagtagctgggacaacaggtgtccgccaccatgcccaattaatttttttgtatttgtagagatggggtttcaccgtgttagctaggatggtctcgatctcctgaccttgtgatccgcccgccttggcctcccaaagtgctgggattacaggcgtgagctaccgtgcccggctattaataatgttaacaataactaatgattattgagcatttactacatgtcaggtcctgaattatgtatattatttcatttactcctcataaaagggttccttctaggagctaggggagaaaaccagccattatatagtcaataataatattaatggtaataatagttattatatataacagttatatattacataacatatgctggccctgaattgaacatattctctaatttgatttttgaatatttaaaaatatacacatatatttgttttttttttttaagagatggaggagtctcaccatgttgcccaagctggcctcaaacccctggcctcaagtgagcctcccacctcagcctcccaagtagctgccaccatgcagtctctaatttaaattttaaacaaaccctagatgttattattatcttagagtaggctgcttctaaaatagctcccaatgatcctcttgctggtctttacatccttgtgtaatctccttgagtgtgggctggacctaatgacttacttctaactcacaggatgtggcaacagtgatgggatgtcacatctgtgattggattacgaaagactgtgccttctgttttgctattactgtctctggtgagtcctctctcttgctcttgcttgcttgcactgatgaagtaagctgccacgttgtgagatgctcaacgaagaggcccatgaggcagggcaccgagggaggcttctggccaacagctcctggggaaccaaggccttaggaagtgagtcctgccaacagccttgaactttgaaaccacagtaccttgttccagcgtggaaagcagcgtggcacttcccggtggtgaaagcaccccagcttgaaagggtgaaaacaccttctcccagatagtctccctttgtttagccagtgcttttgccttaaggaaatcaaatgaaggggtcagccaggagtggatctggaagctggagaactctcaatacgccacttcagtttattgacgacatttataattgcaaccgaagttgactgatttctgctaaatgaaagtttgcgctttgccctttagcattgaggctcctggaaagaacttcaatgaaattggatgcattgagaccaaagaaaagaaggggacatttttatctctctgatacctttctccccagggcttggaaacacttcttaaacacaacctctaatgttggtgttttatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435110 - DNA, 4520 bp, Homo sapiens
ctctgctcactgcaagctccgcctcctgagttcatgccattctcctgcttcagccttctgagtagctgggacaacaggtgtccgccaccatgcccaattaatttttttgtatttgtagagatggggtttcaccgtgttagctaggatggtctcgatctcctgaccttgtgatccgcccgccttggcctcccaaagtgctgggattacaggcgtgagctaccgtgcccggctattaataatgttaacaataactaatgattattgagcatttactacatgtcaggtcctgaattatgtatattatttcatttactcctcataaaagggttccttctaggagctaggggagaaaaccagccattatatagtcaataataatattaatggtaataatagttattatatataacagttatatattacataacatatgctggccctgaattgaacatattctctaatttgatttttgaatatttaaaaatatacacatatatttgttttttttttttaagagatggaggagtctcaccatgttgcccaagctggcctcaaacccctggcctcaagtgagcctcccacctcagcctcccaagtagctgccaccatgcagtctctaatttaaattttaaacaaaccctagatgttattattatcttagagtaggctgcttctaaaatagctcccaatgatcctcttgctggtctttacatccttgtgtaatctccttgagtgtgggctggacctaatgacttacttctaactcacaggatgtggcaacagtgatgggatgtcacatctgtgattggattacgaaagactgtgccttctgttttgctattactgtctctggtgagtcctctctcttgctcttgcttgcttgcactgatgaagtaagctgccacgttgtgagatgctcaacgaagaggcccatgaggcagggcaccgagggaggcttctggccaacagctcctggggaaccaaggccttaggaagtgagtcctgccaacagccttgaactttgaaaccacagtaccttgttccagcgtggaaagcagcgtggcacttcccggtggtgaaagcaccccagcttgaaagggtgaaaacaccttctcccagatagtctccctttgtttagccagtgcttttgccttaaggaaatcaaatgaaggggtcagccaggagtggatctggaagctggagaactctcaatacgccacttcagtttattgacgacatttataattgcaaccgaagttgactgatttctgctaaatgaaagtttgcgctttgccctttagcattgaggctcctggaaagaacttcaatgaaattggatgcattgagaccaaagaaaagaaggggacatttttatctctctgatacctttctccccagggcttggaaacacttcttaaacacaacctctaatgttggtgttttatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435111 - DNA, 4861 bp, Homo sapiens
ctctgctcactgcaagctccgcctcctgagttcatgccattctcctgcttcagccttctgagtagctgggacaacaggtgtccgccaccatgcccaattaatttttttgtatttgtagagatggggtttcaccgtgttagctaggatggtctcgatctcctgaccttgtgatccgcccgccttggcctcccaaagtgctgggattacaggcgtgagctaccgtgcccggctattaataatgttaacaataactaatgattattgagcatttactacatgtcaggtcctgaattatgtatattatttcatttactcctcataaaagggttccttctaggagctaggggagaaaaccagccattatatagtcaataataatattaatggtaataatagttattatatataacagttatatattacataacatatgctggccctgaattgaacatattctctaatttgatttttgaatatttaaaaatatacacatatatttgttttttttttttaagagatggaggagtctcaccatgttgcccaagctggcctcaaacccctggcctcaagtgagcctcccacctcagcctcccaagtagctgccaccatgcagtctctaatttaaattttaaacaaaccctagatgttattattatcttagagtaggctgcttctaaaatagctcccaatgatcctcttgctggtctttacatccttgtgtaatctccttgagtgtgggctggacctaatgacttacttctaactcacaggatgtggcaacagtgatgggatgtcacatctgtgattggattacgaaagactgtgccttctgttttgctattactgtctctggtgagtcctctctcttgctcttgcttgcttgcactgatgaagtaagctgccacgttgtgagatgctcaacgaagaggcccatgaggcagggcaccgagggaggcttctggccaacagctcctggggaaccaaggccttaggaagtgagtcctgccaacagccttgaactttgaaaccacagtaccttgttccagcgtggaaagcagcgtggcacttcccggtggtgaaagcaccccagcttgaaagggtgaaaacaccttctcccagatagtctccctttgtttagccagtgcttttgccttaaggaaatcaaatgaaggggtcagccaggagtggatctggaagctggagaactctcaatacgccacttcagtttattgacgacatttataattgcaaccgaagttgactgatttctgctaaatgaaagtttgcgctttgccctttagcattgaggctcctggaaagaacttcaatgaaattggatgcattgagaccaaagaaaagaaggggacatttttatctctctgatacctttctccccagggcttggaaacacttcttaaacacaacctctaatgttggtgttttatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435112 - DNA, 3089 bp, Homo sapiens
ggtgggcctgttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435113 - DNA, 3235 bp, Homo sapiens
tctgtgttaactctgagagaacaaataatggctttttaaagactgttaatagaataatgaagacttactgtgtttttaacgtgaaaattttaggtgaccaagggtcctgctataacatactgggggtcataggatagtagaatggtcaacatctcaatttagacatgttacttcctgctctaaatacacttgtggacgctacttgtggtgtaactccttatgtatttaataattatctgactctggttttcttggttgatttttttaaatgggtgaagaatctagttatgaattctttgccctttatggaatgtgatatcttggtttttattccatctgttacttcccttttacttaattttatcttattgttttgcgttgtgtttctaaaataatggctttggcttgttttttcctgaatgtttctgcagtttggtttgagtatctgggtttgggcaccactcctgaacttggactccatctgtacttgtgacttttggaaggcagagtcagtgttttctgtggaagatgacatttttttaatattatatatgtgtatctccccctcccctttttggtttctcttaaaagactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435114 - DNA, 2666 bp, Homo sapiens
  misc_feature (24)..(24): n is a, c, g, or t
atcattttcttcttccggctctcnctgctaggggcttaagcggagggagtcgagccagcgtcgccgcgatggtgttgttggagagcgagcagttcctgacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435115 - DNA, 2886 bp, Homo sapiens
gagcaaacagagctttagcacacataattagcttcctcagtgatacagaagtatcctagagtcagtattaagaataaaggccctagcgtcctacacctctgctcactttttcatgttatcatagatcatatgcttagtactggagactttggagaaaaatgagattgatgacattgtcatagtttgttacagagaaaagcactaagcatccactagtgcccagacttgaacccattttcctgacagaattactaaaggctccagaacctaattcagatcacagtcttgagaacacgttggaaggcatacaggttgcaaatgtcttctacaaagatctggctagctgaacatcttggcacaaaaaggacagatcctcaacagtgttataagaagaagaaatgaagaaatttggggatttgtaagggaggaagatgtgccttagtacattaattgttgacattttatactttcccatctgaaaagccaatgaaattgtggccagtaaattttttgaaactggttttgtagccctgccatacagttaattgagccttttcttacataagcaggagatacagtataaagtgccagcttgcatcatactgtcaaatttcaggattattccatttttctgtctggagccattttctgtttgccttgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtag

SEQ ID NO: 435116 - DNA, 3585 bp, Homo sapiens
ggtgggcctgttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagcttttgcccatgaagggctgttctttcccctttcctttattagtaaatgaatttatttttcgttcttttggtcttactctc

SEQ ID NO: 435117 - DNA, 3552 bp, Homo sapiens
ggtgggcctgttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgggagaagactgcagtcttctcccatcagttataaccaaacaagaggtcaatgtatagaaatccgctgatgggacgcagatgcggggtcctctaa

SEQ ID NO: 435118 - DNA, 3539 bp, Homo sapiens
ctctgctcactgcaagctccgcctcctgagttcatgccattctcctgcttcagccttctgagtagctgggacaacaggtgtccgccaccatgcccaattaatttttttgtatttgtagagatggggtttcaccgtgttagctaggatggtctcgatctcctgaccttgtgatccgcccgccttggcctcccaaagtgctgggattacaggcgtgagctaccgtgcccggctattaataatgttaacaataactaatgattattgagcatttactacatgtcaggtcctgaattatgtatattatttcatttactcctcataaaagggttccttctaggagctaggggagaaaaccagccattatatagtcaataataatattaatggtaataatagttattatatataacagttatatattacataacatatgctggccctgaattgaacatattctctaatttgatttttgaatatttaaaaatatacacatatatttgttttttttttttaagagatggaggagtctcaccatgttgcccaagctggcctcaaacccctggcctcaagtgagcctcccacctcagcctcccaagtagctgccaccatgcagtctctaatttaaattttaaacaaaccctagatgttattattatcttagagtaggctgcttctaaaatagctcccaatgatcctcttgctggtctttacatccttgtgtaatctccttgagtgtgggctggacctaatgacttacttctaactcacaggatgtggcaacagtgatgggatgtcacatctgtgattggattacgaaagactgtgccttctgttttgctattactgtctctggtgagtcctctctcttgctcttgcttgcttgcactgatgaagtaagctgccacgttgtgagatgctcaacgaagaggcccatgaggcagggcaccgagggaggcttctggccaacagctcctggggaaccaaggccttaggaagtgagtcctgccaacagccttgaactttgaaaccacagtaccttgttccagcgtggaaagcagcgtggcacttcccggtggtgaaagcaccccagcttgaaagggtgaaaacaccttctcccagatagtctccctttgtttagccagtgcttttgccttaaggaaatcaaatgaaggggtcagccaggagtggatctggaagctggagaactctcaatacgccacttcagtttattgacgacatttataattgcaaccgaagttgactgatttctgctaaatgaaagtttgcgctttgccctttagcattgaggctcctggaaagaacttcaatgaaattggatgcattgagaccaaagaaaagaaggggacatttttatctctctgatacctttctccccagggcttggaaacacttcttaaacacaacctctaatgttggtgttttatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggttttgtatgttcaaactgtcattttatttttacgttgttagatatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattat

SEQ ID NO: 435119 - DNA, 3173 bp, Homo sapiens
ctctgctcactgcaagctccgcctcctgagttcatgccattctcctgcttcagccttctgagtagctgggacaacaggtgtccgccaccatgcccaattaatttttttgtatttgtagagatggggtttcaccgtgttagctaggatggtctcgatctcctgaccttgtgatccgcccgccttggcctcccaaagtgctgggattacaggcgtgagctaccgtgcccggctattaataatgttaacaataactaatgattattgagcatttactacatgtcaggtcctgaattatgtatattatttcatttactcctcataaaagggttccttctaggagctaggggagaaaaccagccattatatagtcaataataatattaatggtaataatagttattatatataacagttatatattacataacatatgctggccctgaattgaacatattctctaatttgatttttgaatatttaaaaatatacacatatatttgttttttttttttaagagatggaggagtctcaccatgttgcccaagctggcctcaaacccctggcctcaagtgagcctcccacctcagcctcccaagtagctgccaccatgcagtctctaatttaaattttaaacaaaccctagatgttattattatcttagagtaggctgcttctaaaatagctcccaatgatcctcttgctggtctttacatccttgtgtaatctccttgagtgtgggctggacctaatgacttacttctaactcacaggatgtggcaacagtgatgggatgtcacatctgtgattggattacgaaagactgtgccttctgttttgctattactgtctctggtgagtcctctctcttgctcttgcttgcttgcactgatgaagtaagctgccacgttgtgagatgctcaacgaagaggcccatgaggcagggcaccgagggaggcttctggccaacagctcctggggaaccaaggccttaggaagtgagtcctgccaacagccttgaactttgaaaccacagtaccttgttccagcgtggaaagcagcgtggcacttcccggtggtgaaagcaccccagcttgaaagggtgaaaacaccttctcccagatagtctccctttgtttagccagtgcttttgccttaaggaaatcaaatgaaggggtcagccaggagtggatctggaagctggagaactctcaatacgccacttcagtttattgacgacatttataattgcaaccgaagttgactgatttctgctaaatgaaagtttgcgctttgccctttagcattgaggctcctggaaagaacttcaatgaaattggatgcattgagaccaaagaaaagaaggggacatttttatctctctgatacctttctccccagggcttggaaacacttcttaaacacaacctctaatgttggtgttttatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagaggtaatgtagcatctacctgactcactgggtactcgagcactgaagcattctcatcacttcccatgaagacactaatcccattaaactaggcattcctctttccctgaggttcgttgatagttgtatcttttgtcatttcccatagtgggaaaactaaggtccgtggagggggatgtgaatccataatttctcttcaacaaacaggcagcagagccattgtggaatttctagcctaagccataagatttgtggtttgtcctgatgtaagtgcattcactgcctttcagccaacctgctcccaaacatcaagggtctcaagtttctattcttattctgccattgggacccagcagggaattaattaaagaggccttagaaacacatagcattaccagcagaagaaatggatatgtgctcattgtccttctggctggttggctccataaggaggaaactctagacaggtctttcgtgtacatctaagatctgttgttcatcacagacagtggacttgttcacaagtattcattacctttcagaaccgtctcacaggcctttgtgtggcctctgtacagctatgccagcctctataggtctatcctcgtcataaaatctgtagctaaagtattaga

SEQ ID NO: 435120 - DNA, 2987 bp, Homo sapiens
ctctgctcactgcaagctccgcctcctgagttcatgccattctcctgcttcagccttctgagtagctgggacaacaggtgtccgccaccatgcccaattaatttttttgtatttgtagagatggggtttcaccgtgttagctaggatggtctcgatctcctgaccttgtgatccgcccgccttggcctcccaaagtgctgggattacaggcgtgagctaccgtgcccggctattaataatgttaacaataactaatgattattgagcatttactacatgtcaggtcctgaattatgtatattatttcatttactcctcataaaagggttccttctaggagctaggggagaaaaccagccattatatagtcaataataatattaatggtaataatagttattatatataacagttatatattacataacatatgctggccctgaattgaacatattctctaatttgatttttgaatatttaaaaatatacacatatatttgttttttttttttaagagatggaggagtctcaccatgttgcccaagctggcctcaaacccctggcctcaagtgagcctcccacctcagcctcccaagtagctgccaccatgcagtctctaatttaaattttaaacaaaccctagatgttattattatcttagagtaggctgcttctaaaatagctcccaatgatcctcttgctggtctttacatccttgtgtaatctccttgagtgtgggctggacctaatgacttacttctaactcacaggatgtggcaacagtgatgggatgtcacatctgtgattggattacgaaagactgtgccttctgttttgctattactgtctctggtgagtcctctctcttgctcttgcttgcttgcactgatgaagtaagctgccacgttgtgagatgctcaacgaagaggcccatgaggcagggcaccgagggaggcttctggccaacagctcctggggaaccaaggccttaggaagtgagtcctgccaacagccttgaactttgaaaccacagtaccttgttccagcgtggaaagcagcgtggcacttcccggtggtgaaagcaccccagcttgaaagggtgaaaacaccttctcccagatagtctccctttgtttagccagtgcttttgccttaaggaaatcaaatgaaggggtcagccaggagtggatctggaagctggagaactctcaatacgccacttcagtttattgacgacatttataattgcaaccgaagttgactgatttctgctaaatgaaagtttgcgctttgccctttagcattgaggctcctggaaagaacttcaatgaaattggatgcattgagaccaaagaaaagaaggggacatttttatctctctgatacctttctccccagggcttggaaacacttcttaaacacaacctctaatgttggtgttttatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaaggttggtgccctctgacctgctcagctgttctctttacaaccagtacttttagtacactgctcactaactgtaagttggcatcctgagcttcccaaggcctggtcagacccattaatttctctatttgatgtcttagattcattgatttctccattcgacgatgtctttgtgcccttcctgttttctaagatgtctgtgtttgtcattctgcatgtgcccatctttcaccccattctataaggaatttctgtagtcccaacctactgccttatttcccacttgactgttaaggatcagcata

SEQ ID NO: 435121 - DNA, 2430 bp, Homo sapiens
ctctgctcactgcaagctccgcctcctgagttcatgccattctcctgcttcagccttctgagtagctgggacaacaggtgtccgccaccatgcccaattaatttttttgtatttgtagagatggggtttcaccgtgttagctaggatggtctcgatctcctgaccttgtgatccgcccgccttggcctcccaaagtgctgggattacaggcgtgagctaccgtgcccggctattaataatgttaacaataactaatgattattgagcatttactacatgtcaggtcctgaattatgtatattatttcatttactcctcataaaagggttccttctaggagctaggggagaaaaccagccattatatagtcaataataatattaatggtaataatagttattatatataacagttatatattacataacatatgctggccctgaattgaacatattctctaatttgatttttgaatatttaaaaatatacacatatatttgttttttttttttaagagatggaggagtctcaccatgttgcccaagctggcctcaaacccctggcctcaagtgagcctcccacctcagcctcccaagtagctgccaccatgcagtctctaatttaaattttaaacaaaccctagatgttattattatcttagagtaggctgcttctaaaatagctcccaatgatcctcttgctggtctttacatccttgtgtaatctccttgagtgtgggctggacctaatgacttacttctaactcacaggatgtggcaacagtgatgggatgtcacatctgtgattggattacgaaagactgtgccttctgttttgctattactgtctctggtgagtcctctctcttgctcttgcttgcttgcactgatgaagtaagctgccacgttgtgagatgctcaacgaagaggcccatgaggcagggcaccgagggaggcttctggccaacagctcctggggaaccaaggccttaggaagtgagtcctgccaacagccttgaactttgaaaccacagtaccttgttccagcgtggaaagcagcgtggcacttcccggtggtgaaagcaccccagcttgaaagggtgaaaacaccttctcccagatagtctccctttgtttagccagtgcttttgccttaaggaaatcaaatgaaggggtcagccaggagtggatctggaagctggagaactctcaatacgccacttcagtttattgacgacatttataattgcaaccgaagttgactgatttctgctaaatgaaagtttgcgctttgccctttagcattgaggctcctggaaagaacttcaatgaaattggatgcattgagaccaaagaaaagaaggggacatttttatctctctgatacctttctccccagggcttggaaacacttcttaaacacaacctctaatgttggtgttttatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgtatgtatttgatggttgccagtgttgatctatatgctatcaatattttcttaaaagattttgctcagtacattttagtgacccagtaaaaactgtgtttctgttaaaaagatgtgggcttgctaataaggagcatctcagccaagcgcggtggctcactcctgtaatcctagcactttgggaggctgaggcaggaggattacatgaggccaggagtttgagaccagcctgggcaacatttcaagaccctgtctctattaatttcaaaaattttttcttaaataataaaataataattaaaaaatttaaaagcatctcatgttgcccatccagaggtataaattattagatgagccgtttaaatttaggccagatattatcctaaaggtacttttgatttataacccatatgaaacaaatgttgtgaaatctgatagaagaatagtattctaagactaggattaaactgttacagttaacatcttaccctaactgtgataactgggctataaattaggggttttaaatatactgtaaaaaatagcttcctgggg

SEQ ID NO: 435122 - DNA, 1958 bp, Homo sapiens
ctctgctcactgcaagctccgcctcctgagttcatgccattctcctgcttcagccttctgagtagctgggacaacaggtgtccgccaccatgcccaattaatttttttgtatttgtagagatggggtttcaccgtgttagctaggatggtctcgatctcctgaccttgtgatccgcccgccttggcctcccaaagtgctgggattacaggcgtgagctaccgtgcccggctattaataatgttaacaataactaatgattattgagcatttactacatgtcaggtcctgaattatgtatattatttcatttactcctcataaaagggttccttctaggagctaggggagaaaaccagccattatatagtcaataataatattaatggtaataatagttattatatataacagttatatattacataacatatgctggccctgaattgaacatattctctaatttgatttttgaatatttaaaaatatacacatatatttgttttttttttttaagagatggaggagtctcaccatgttgcccaagctggcctcaaacccctggcctcaagtgagcctcccacctcagcctcccaagtagctgccaccatgcagtctctaatttaaattttaaacaaaccctagatgttattattatcttagagtaggctgcttctaaaatagctcccaatgatcctcttgctggtctttacatccttgtgtaatctccttgagtgtgggctggacctaatgacttacttctaactcacaggatgtggcaacagtgatgggatgtcacatctgtgattggattacgaaagactgtgccttctgttttgctattactgtctctggtgagtcctctctcttgctcttgcttgcttgcactgatgaagtaagctgccacgttgtgagatgctcaacgaagaggcccatgaggcagggcaccgagggaggcttctggccaacagctcctggggaaccaaggccttaggaagtgagtcctgccaacagccttgaactttgaaaccacagtaccttgttccagcgtggaaagcagcgtggcacttcccggtggtgaaagcaccccagcttgaaagggtgaaaacaccttctcccagatagtctccctttgtttagccagtgcttttgccttaaggaaatcaaatgaaggggtcagccaggagtggatctggaagctggagaactctcaatacgccacttcagtttattgacgacatttataattgcaaccgaagttgactgatttctgctaaatgaaagtttgcgctttgccctttagcattgaggctcctggaaagaacttcaatgaaattggatgcattgagaccaaagaaaagaaggggacatttttatctctctgatacctttctccccagggcttggaaacacttcttaaacacaacctctaatgttggtgttttatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcaggggagtgacaggcttggatttgtgtgtggggaaaactggtctggtctcagcgtgagg

SEQ ID NO: 435123 - DNA, 565 bp, Homo sapiens
tgacttttggaaggcagagtcagtgttttctgtggaagatgacatttttttaatattatatatgtgtatctccccctcccctttttggtttctcttaaaagactggaaagaaagcagttaaagcagttctgtgggtctcagcagatggactcagagttgtggatgaaaaaactaaggtaagattctttatttttattttgatttattttattttttttggagatggagtttcactcttgtcacccaggctggagtgcaatggcacgatctcggcccaccgcaacctccacctcccaggttcaagcgattctcctgcctcagcctccctagtagctgggattacaggcatgtgccaccatgcccagctaattttgtatttttagtagaaatggggtttctccatgttggtcaggctggtctcgaactcctgacctcaggtgatccgcccacctcggcctcccaaagtgctgggattacaggtgtgagccactgcgcccggcctcgcctggctaatttttgtattattagtagatacggggtttcaccatgttggccaggctgatct

SEQ ID NO: 435124 - DNA, 1015 bp, Homo sapiens
gatccattagcgtataattgaatatcaaagggaattttaccttaaacatatatcaagtctatactcagctaatcgttttgtctaaacacagccttgttagcatttgaatttacaaatattcatttgcttatttgcagtgttccttttgcttttagaataaatcataaatatttccccaatactgtcaagatacttcttcaactttgtccctgaaccatcagctttctttagggtccgggtatcctttacacttcaatggggttttcttgtgtgtgtcattgggggtaactccattgacctcagcatttctatctcaagagatggctctggaacacagaaccagaggcaacaggtactaatggttgataaaattaacagcgactgcataaccattttccacatggcagggctgtgcttaagccccacacctccaataatcaatttctatgacggtactaataaccttaactatatgcaaattcttcaccacttatgatatggtacaaactggagtttacagatggccttggccttgcctagcccatttgttcatcctaacttcttcatcacttcctgatgcacttggggaagcatgttgacacaacgttaccaatatttgattacctatggttatctgcaattacctacgcttatcttatcagaccctagatgccatttgagccccttacttctttgggcagtgggtgaaatgggagaacatagagaaatgttcactttgacctaagaaacgcataaaagggaatgccatgcacaatgtaagataaaatgtttggggacaggggatcatcgtgaaatttatttctgctattctgccctattgaggtcattaattataatggatttaaagatttttttttaaactctacaaacactaagccaaggaattcaggttatctgctatgttaacctaataaagcaaaggaaaatatgttgctttaatccttgcttgttaacctaataaagcaaaggaaaatatgttgctttaaaacttgct

SEQ ID NO: 435125 - DNA, 929 bp, Homo sapiens
tgctagtagaagcctggaaataactgagatgccaataaacaggaaaattactaattatatctatacaatgaaatctatgcaactgatttaaaattaaggatgcaccctcttatttttagtgtgtatgtataaatggatacgtggtatgttgtcaaagaaggtttagaagttcaatttaaataatactgaagatacctgctattgtataagcaatgaaaatgctatacagatgttctgaaataaaacaaacacacccatactctgaccactgaactttggaccagtattgctcttcattagtatcctaaaatgtatggacattttatgggtcattgttccaaacctgtctttggagctatttggagtagcacagaaccaacctgtctttagagcttccttgagcagcacagaaaagggactttcagagcttcaggagacagtatttcatccaagtgcagcttctggaagtgaaatgtatttagaaggtttgctctgctattgtaatttcccaagtaggcccatgtgactctgcaaaccctaggcctgagccagatttgtttgaaatgtcagccaaactaccagcaccttacatcatgatatggtctgactctgtgttcccatccaaatctcatatcaaattgtaattcccagtgttgcaggaggggcccagtgggaggtgatcgaatcatgggggtggacctcccccttgctgttcttgtgatagaattttccttatatctgcttgtttaaaagtgtgtttaaaggcaccttccccacacttcctgccagccatatgaagatgggcttgcttccctttcaacttctgccatgattgtaagtttcctgaggcctacccagaaacagaagcctgtacagcctgcagaactatgagctgattaaacctcttttctttataaattacccagtct

SEQ ID NO: 435126 - DNA, 777 bp, Homo sapiens
gagagggagtttcgctcttgttgcccatgctggagtgcaatggcacgatcttggcccactgcaacctccatctcctgggttcaagcgatcttcccgcctcagccttccaagtagctgggattacagacgtgtgccatcaggcctggctaattttgtatttttagtagagacagggtttcgccatgttggtcaggatggtctcgaactcctgacctcaactgatccacccgcctcagcctcccaaagtgctaggattacaggtgtgagccactgcacccggccctgcccccagtcttgaccattctactaattttaaagaacatcttggaattttacactcttggaatcatagtcgtagaatcctttttttgagacagagtctcactctgtcgcccaggctggagtgcagtggccagatctcagctcactgaaacctcagcctcccaagttcaagtgattctcgtacctcagcctcctgagtagctggaattccaggctgtactcactgctttgctcatatcctcgctcattaccagggacaggccagcacccctgcattgcatctcacatatccactgatggatggagaacagactgaaattcagtgccttagagaccacacactccaaccccctcattgtgcagatgggaaaactgagagccatagaagggaagtggcttgcccaaagccacacttactgttttccccacactgtaccacaaactttcaccattcttcaggtttggaaaaatactaataaactgatcaacactaaa

SEQ ID NO: 435127 - DNA, 430 bp, Homo sapiens
  misc_feature (54)..(54): n is a, c, g, or t
ctagaggatccgacagcatagaatgcatagaatggtcaagactgggggcaggcngggtgcagtggccagatctcagctcactgaaacctcagcctcccaagttcaagtgattctcgtacctcagcctcctgagtagctggaattccaggctgtactcactgctttgctcatatcctcgctcattaccagggacaggccagcacccctgcattgcatctcacatatccactgatggatggagaacagactgaaattcagtgccttagagaccacacactccaaccccctcattgtgcagatgggaaaactgagagccatagaagggaagtggcttgcccaaagccacacttactgttttccccacactgtaccacaaactttcaccattcttcaggtttggaaaaatactaataaactgatcaacactaaa

SEQ ID NO: 435128 - DNA, 321 bp, Homo sapiens
acttgataaataatttacagttatctaaatacagtgcctgactcaacataaagacacagaggaagtttaaatggaaagtttaattcaggttacttttgtcaggtatctctcttacataccaaaataaaaatgtataaatacaaaaaaaaaattagccaggcgtggtggctaattgagaggagatggggaaaagtgatgtggggttccccaatgttgtccaaggggatttcttcttagaaatctctccctacatcactcttgtagtgaaataaaaccatctccatgtaatttattaattttgttttttgaaaaatatccact

SEQ ID NO: 435129 - DNA, 256 bp, Homo sapiens
gcagtgtttgaagaagatattctttgccagatcccagttcttcttttggaggaaatgaagcaaaacctcacacgtccgtaactcgttttccataatgctagcagggtcatttggcaaagcgcaccgaagcaagactctctgcaggggtcagcatccggctgcctccgcagactgagctctttacgaggcaggcagggagtcgttttgcttggtggtagcagtgttcagagtgatttttatcgccatgcacggggat

SEQ ID NO: 435130 - DNA, 714 bp, Homo sapiens
cataaatttgattttgccatggtgcttagaaacagtctaataaaaaggaaaaaagtgtacagagagagaaaaataactacactaaaacagaactgtttttacctttttaaaaaatttggtgggaggttaggatcatattctgaattagttcggtaaacctcaaaatactgtctcccaccgcacatggtttcaccacttaagaaatgatgatcgtatctgctcacaaccattttacttgcatctcatttacagatgctaaatctagtctcagaggaggcaaaacatgtatgcattcttaagttataaagtgtactgatttcacaaatatgaagaattttagaaattcaaatttttaatggatgtgtcaccatctacagctgtcatcctgcatggctgatatctgctgcaaatcttgaataaatttccagttcagttgggcagcaaaaactcaattagctctaaaggcagcttgtgtttcaggattccgccactgcccattttccccaatatgtcaaaatatggaataggtgaaatcagccccttatgtatagtacatggacacatctgttgtgactacaccatgttcgaactgctactaaatatcagctattgtatgaatttatggtgttgaatgagcaccagcaatgtgttttaaataatttgtgtatatgtgtagcccagtttgttttatattggtcaataaattctaaagac

SEQ ID NO: 435131 - DNA, 5137 bp, Homo sapiens
  misc_feature (193)..(193): n is a, c, g, or t
actggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccncgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactggctcggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaaaaaat

SEQ ID NO: 435132 - DNA, 1289 bp, Homo sapiens
cggtacgagctcgtgccgaattcggcacgagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaaaaaat

SEQ ID NO: 435133 - DNA, 403 bp, Homo sapiens
ccatatggttgcaatgcccaattgttaaatttcacaaaagccaccaaagtcaaagtaattaagctagctttactccagaggagaccagagctcctctgctcacatgcccatggttggtcaaaaacattcttgctggaaattgggagactgaggtttactcctggccctggcaacaggagttggcaaatggcagctgagtccatttgctctgggctcagactgctcatgtggaaagcaggagggtgggactgatgacctccaagactcctcttccagtgtccgcaattcggtgtcgctggaccatgaaatagaaatgaggagctgcaaggttttgggtgctccactccttctgggtgggttggaataaattaaattcagaaaaataaatcactttttaaataga

SEQ ID NO: 435134 - DNA, 5083 bp, Homo sapiens
  misc_feature (193)..(193): n is a, c, g, or t
actggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccncgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactggctcggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaaaaaat

SEQ ID NO: 435135 - DNA, 5062 bp, Homo sapiens
  misc_feature (193)..(193): n is a, c, g, or t
actggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccncgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaagctcggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaaaaaat

SEQ ID NO: 435136 - DNA, 4956 bp, Homo sapiens
  misc_feature (193)..(193): n is a, c, g, or t
actggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccncgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaagtggtcagccgtgaattaagaatgccaatgtcgaatgtccacctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactggctcggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaaaaaat

SEQ ID NO: 435137 - DNA, 5095 bp, Homo sapiens
  misc_feature (193)..(193): n is a, c, g, or t
actggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccncgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcagctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactggctcggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaaaaaat

SEQ ID NO: 435138 - DNA, 3341 bp, Homo sapiens
gcacaaaacaaaaatttattgggagaaagatggctgatgggaggcaagatctggattcaggaatcctcaattttagctctcgctctgtcaccaaaaccctccgtccctcccagagctcgtgactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaagctcggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaaaaaat

SEQ ID NO: 435139 - DNA, 4535 bp, Homo sapiens
  misc_feature (193)..(193): n is a, c, g, or t
actggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccncgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactggctcggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacacta

SEQ ID NO: 435140 - DNA, 1569 bp, Homo sapiens
ggcacgagcggcacgagcggcacgaggatgcctgtcaaactcttctaaaacgcctcgaacccatcatcagcaagaatcctaaaggaacttggaaagactggctcggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaaaaaat

SEQ ID NO: 435141 - DNA, 5008 bp, Homo sapiens
  misc_feature (193)..(193): n is a, c, g, or t
actggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccncgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaagctcggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagtgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaaaaaat

SEQ ID NO: 435142 - DNA, 4153 bp, Homo sapiens
  misc_feature (193)..(193): n is a, c, g, or t
actggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccncgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatcctacaaacaagagatcaatgccaagaacctaatccagtgttggagagaatgtatggccatgtcttcctactccttgaggaaagttgctgtggaaaagttcaagttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaaaaaat

SEQ ID NO: 435143 - DNA, 4364 bp, Homo sapiens
  misc_feature (193)..(193): n is a, c, g, or t
actggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccncgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaagctcggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgggagcacatggcaagcctgtcaggcggacacaggaacaggtgcttttgatacaacttcacaagattcagccaatgctggtggcataatgtcacattccaaggcgtcagatgaacttggtttgtttgtacgtgaatggaagaacagtaagttttctacattattaatcaattcata

SEQ ID NO: 435144 - DNA, 600 bp, Homo sapiens
gcagatcttggcatgcaataaatgtcctagtgaggacatttattagtgagtaaatgagggtcagttactcctggactgtggattttatatgagttgtcatttatttctctagatcattctgtgagttgggttctaatattccccttttacaggtgaggacatggcgagacccaggctagccaccttgagaatggtgggccaatttgaactcgggctgcctgatccagagcttgtactcttatttcctgtattaaactatggctatttgtcttacccattagatgaagatatggggtaataaaccctgtcaggctaggagtcttctctttggactttccaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggtaaacaactgtttacacattaacttccccagtactgggagctatgatgacaccaaaagtagaggcaatgactccctaccaaatagctgtagaataa

SEQ ID NO: 435145 - DNA, 670 bp, Homo sapiens
tcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggtgagttctccaaatgcacatgaggatgctgcctggaagcagccctgacaaagcaagaggtgttgaggaaacttctccttaagtcatattagccatatggttgcaatgcccaattgttaaatttcacaaaagccaccaaagtcaaagtaattaagctagctttactccagaggagaccagagctcctctgctcacatgcccatggttggtcaaaaacattcttgctggaaattgggagactgaggtttactcctggccctggcaacaggagttggcaaatggcagctgagtccatttgctctgggctcagactgctcatgtggaaagcaggagggtgggactgatgacctccaagactcctcttccagtgtccgcaattcggtgtcgctggaccatgaaatagaaatgaggagctgcaaggttttgggtgctccactccttctgggtgggttggaataaattaaattcagaaaaataaatcactttttaaatagaat

SEQ ID NO: 435146 - DNA, 2235 bp, Homo sapiens
cgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttccctgagttcagccgccgcctcatcaaggacctggagagcatgttcaaactgtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccacagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttc

SEQ ID NO: 435147 - DNA, 1308 bp, Homo sapiens
  misc_feature (1201)..(1201): n is a, c, g, or t
  misc_feature (1213)..(1213): n is a, c, g, or t
  misc_feature (1225)..(1228): n is a, c, g, or t
  misc_feature (1231)..(1231): n is a, c, g, or t
  misc_feature (1234)..(1234): n is a, c, g, or t
  misc_feature (1239)..(1239): n is a, c, g, or t
  misc_feature (1241)..(1241): n is a, c, g, or t
  misc_feature (1244)..(1244): n is a, c, g, or t
  misc_feature (1271)..(1271): n is a, c, g, or t
cgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttccctgagttcagccgccgcctcatcaaggacctggagagcatgttcaaactgtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctngggagaggtgtnggtgagaaatgnnnnganaanaaatnantanggatgttgatgagttgtttggttgggngggttaaggaagatgtggatggaggaggggttggaag

SEQ ID NO: 435148 - DNA, 1271 bp, Homo sapiens
cgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttccctgagttcagccgccgcctcatcaaggacctggagagcatgttcaaactatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtaggtgcttagttccttctgtgaggagcaaccactcccagccttcacgctgcccaccagactgcagctgtcattttcatctcagcagagcacacctgcagaaacagaccaggagggtcctcccagtgctctgccaaccagcaagtgggtgccagtccacctgagttcagactctgcctcctccatctccctaccctgtccactctgagcctcggtgtcttcatctgtatgatggaggggtgacaatagaattgcctgaatgattaaatgagttcatgtacatgaaagcatttaggaagtgcctggctcactgtgagcccttcataggtggtatgggct

SEQ ID NO: 435149 - DNA, 1041 bp, Homo sapiens
cgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttccctgagttcagccgccgcctcatcaaggacctggagagcatgttcaaactcattcccccagtccctccctcttcaccttgctccgtctatgtcttcccagctcagccttttccccactcttaaatactgtactatcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttc

SEQ ID NO: 435150 - DNA, 2757 bp, Homo sapiens
cgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttccctgagttcagccgccgcctcatcaaggacctggagagcatgttcaaactgtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccacagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttcaaaaaaaaaaaaaaaaaaaaaaaaaaaaaaaacaacaagaaaagggggcggcgccccactaaaaagttccccccgcggagagccccccagatctacccccactaccccagtgttctgtggtcacaaaggtgggccccctagaggagcgccgatattataacaacccacagacaagcggccccgctctttacaacaaccgttcaggtgacatggagaacacaatctgctatcctgggggacactctggtggggagaagacccacccccaaatcctggcggggggtgggaaccatatgttggaccaatcatctccccctaaacagaatttttgaacagcgccccatgggagtaaaaattaagcaactttctcacggtgttcatcaacgggtgtttaaccactaagctgggcaatattctggttcgcagtgatttgaaaaaaatgttcgtgacctccgacggaagtatttgctctttcgacgaacacatcttttataacccaggggaacttttattttatataag

SEQ ID NO: 435151 - DNA, 2314 bp, Homo sapiens
cgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttccctgagttcagccgccgcctcatcaaggacctggagagcatgttcaaactaatctgaaacggtgatgtcatggatgtcctgccagtgccagagtcccgcgttaccaagacaccagtgaaacccaaaaaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccacagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttc

SEQ ID NO: 435152 - DNA, 1650 bp, Homo sapiens
aaagccctgaagcgctctgaggagagaggggttcctctggagcaggtgacccacattggcctcgcagagcgggaggtatttgagtcatttttcgatgaatgaagccaaaggaattacatgtttcggagactaacgagtgtcctttcatcccggtcatgcattcctttgaccctgcaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccacagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttc

SEQ ID NO: 435153 - DNA, 2183 bp, Homo sapiens
cgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttccctgagttcagccgccgcctcatcaaggacctggagagcatgttcaaactgtatgacgctgggcgggatggcttcatcgacctgatggagctgaagctgatgatggagaagatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccacagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttc

SEQ ID NO: 435154 - DNA, 1520 bp, Homo sapiens
ttgaaaggctggaaatgcatgaggaggaggaacaagaacatgtgtgtctggacaggtgcggcagccctggcggagcccactgtccccattcttatggaccgcctcctggctgctgacccagggactgttctcctaggactggagccttggacacttgggtttgggagtgaacgagaaaaaagcttcatggggtgcctcttgccggcgttcctaggagccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccacagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttc

SEQ ID NO: 435155 - DNA, 2180 bp, Homo sapiens
cgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttccctgagttcagccgccgcctcatcaaggacctggagagcatgttcaaactgtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccacagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgatgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttc

SEQ ID NO: 435156 - DNA, 1779 bp, Homo sapiens
cgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttccctgagttcagccgccgcctcatcaaggacctggagagcatgttcaaactgtatgacgctgggcgggatggcttcatcgacctgatggagctgaagctgatgatggagaagctgggggccccccagacccacctgggccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccacagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttc

SEQ ID NO: 435157 - DNA, 1384 bp, Homo sapiens
cgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttccctgagttcagccgccgcctcatcaaggacctggagagcatgttcaaactgtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtaggtgcttagttccttctgtgaggagcaaccactcccagccttcacgctgcccaccagactgcagctgtcattttcatctcagcagagcacacctgcagaaacagaccaggagggtcctcccagtgctctgccaaccagcaagtgggtgccagtccacctgagttcagactctgcctcctccatctccctaccctgtccactctgagcctcggtgtcttcatctgtatgatggaggggtgacaatagaattgcctgaatgattaaatgagttcatgtacatgaaagcatttaggaagtgcctggctcactgtgagcccttcataggtggtatgggct

SEQ ID NO: 435158 - DNA, 1426 bp, Homo sapiens
ggcagtacctggggccccggccgggggcggggctgcggatgctcccacttcccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgtt

SEQ ID NO: 435159 - DNA, 1471 bp, Homo sapiens
ggcagtacctggggccccggccgggggcggggctgcggatgctcccacttcccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgttaaaaaaaaaacgaacaaccataccaccacaaacaccaacaggggg

SEQ ID NO: 435160 - DNA, 1693 bp, Homo sapiens
ggcagtacctggggccccggccgggggcggggctgcggatgctcccacttcccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgagtgcgcgggcagggtcttctgggagtggggaagtgggggcgtctagagactgagctgcgggagggagagggacttgtgggtctgatcccatttctccccaccctggggctcttctgtgtctgccaccattcccatatcatccgtagagaaagaggctggggatatttcaggctgtttggctgtccctgtaccccagtcctgaagcccctgcagtggcgggactcaagctcctgacctttgcccggcctggctgggcctctcttgcagtcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgtt

SEQ ID NO: 435161 - DNA, 1598 bp, Homo sapiens
ctgtgtggccccctttacaggtggttctcaaaggcagggtaccagagaagttgatacactgagttgcagtagaagagacaggtcagactgcaggaagttgttcccatatgagaagagaggctcccaccaggctggatacctaattctcccaaagtcatctagccagccttggcagagcggaggccagaatgaggaccctcaactccagagtgggagagagagtgttcaggaggtggccttgtcctctacccttctctgccctgcccttccctggcccccagagaccagtaggatggcactccttatcccctgttagatccccatggcggagttatgtctcttccacactgggggtgtaccccaagggcagggactgaggtccctctttccagagggcagtgatcccagggatgagaagatggtagctactctggggtcccacacaagctgacctggcagcaggggctttgcggccccttccttgctcagctgcctgtttcccctagactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgtt

SEQ ID NO: 435162 - DNA, 1915 bp, Homo sapiens
ggcagtacctggggccccggccgggggcggggctgcggatgctcccacttcccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcaggtgagtgggctgggtgggccattgatggggaggcagataggagctgcggagtgggctgcccaggaatccttgggccacagaggagtccacagagctggggcttggaccccagcattctcaggagtctgcaggcaggggggccctttcttttccttcccatatgtttctgaggctggacatcttgcgaggtcagccctaccccttcggtccctgccaacctgccctctgcagggctctctgggaactgcagtcctacgggtcccaggcctcagcatcctgtggcccggggaagcacagtggcgattgggaacatgcagacctagaacccctaggtggcactatttggccaatggtctgagccctcagtgtgccccggaatttcttggggagtttaaaaaaaatcagatagatggggacccaagggtagaaccctgggtggacaagggcccagcctgaagcccactgagccccagctggggtacattgcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgtt

SEQ ID NO: 435163 - DNA, 1958 bp, Homo sapiens
  misc_feature (1449)..(1449): n is a, c, g, or t
  misc_feature (1455)..(1455): n is a, c, g, or t
ggcagtacctggggccccggccgggggcggggctgcggatgctcccacttcccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgttaaaaaaaaacaaaaaaaaaaaanaaaaanaaaaaaaaaaaaaaaaaaaaaacaaaaaaaaaaacaaaaagagaggaggggcgcgcgcgccccacaaatactatccccgcgggggggcccacaaagctagagccgcgcaccccgcctttttttgaacaaggggggcgccccaatgggaggggctttatataaaaagagcgagagcgacgagcgagcgcggcgcgggtataaaacacagcgggcgcgcgcgggagacaaacacgcgcgccagggaggaaatcattgggatcagagaacaccccctacacggggggggggacaacaaatatggggaaaaaacccccgccccaccaaggagaatcagaaacgcacccaccaagaggagaaggataaaactaacaacattcgcggcgtgttataatgtcgcggtgatcacaaacacacccggataattctggcgggccgcgctaagaaaacatcgtatgcgctacacagtagcactttgtacccgaaacaaaatttttaacacaggg

SEQ ID NO: 435164 - DNA, 2066 bp, Homo sapiens
ggcagtacctggggccccggccgggggcggggctgcggatgctcccacttcccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcaggtgagtgggctgggtgggccattgatggggaggcagataggagctgcggagtgggctgcccaggaatccttgggccacagaggagtccacagagctggggcttggaccccagcattctcaggagtctgcaggcaggggggccctttcttttccttcccatatgtttctgaggctggacatcttgcgaggtcagccctaccccttcggtccctgccaacctgccctctgcagggctctctgggaactgcagtcctacgggtcccaggcctcagcatcctgtggcccggggaagcacagtggcgattgggaacatgcagacctagaacccctaggtggcactatttggccaatggtctgagccctcagtgtgccccggaatttcttggggagtttaaaaaaaatcagatagatggggacccaagggtagaaccctgggtggacaagggcccagcctgaagcccactgagccccagctggggtacattgcagaacggttgcccatcaaccggcgggacctggaccccaatgctgggcgctttgtccgctaccagttcacgcctgccttcctccgcctgaggcaggtgggagccacgtgagtcgctgggctatgggtggtggtgggggtgagggagagggtgtgacgtgggcccttctcagcctctcgtaggggtggcctgtcctgagcctggctggctagttgacttcaaggaccagacttagccctgcctccttttcttgctcagggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgaccccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgtt

SEQ ID NO: 435165 - DNA, 3843 bp, Homo sapiens
gtatgattccatttatatgaagtatctggaataagcaaatctattagacacagaaagtagatgagtggttgcctaggactgagagggagtttgggaggaaatggagattcactgctactgagtacagagtttcttttggggaggtgataaaaatgctctgaaattgactgtggtggttgtacaattcagaatacactaaacaccattaaattatacactttaagtgggtcagttgtatatagtgcctcaataatatgtaataaaacaatcaattagctcagaaatctgttagagcagggctcagcagggaagcctcatctgttcctcagtgtctcagaggtgatctagcagctggaggctagggttgcctgaagacattcactcaagcatgtggcagttgctgctgagggccagctggaatatcagctgctgtcatcaaccggcacacacgtgacctctgcatgtggcttccaagggagcacatcccaggcaaactaggcagaagccatgtggccttttatgtcccagcctcagaagtccataacatcactcttgtgtcctgggaggagagtcaaagatacctgtgcaaagagcacgtgagagaatggagtggttatctttggaaaataaactgtaacacttggagcaacagtcctgagtggagaaggtgagccccgggacctgccaggagactgtgtcttgactatccccatcagagatgcattttctgctatgtcacatcccatccgttagaatcttccggatactatatctcatagttgatggtctcttgaattcagcaatttcatatctaaagagattcttgaagacaccatgttgtacaccttaaatatatatacaatttttatttgttaattaaaaaataaataagtgaggccagagtgctgggattgcaggcgtgagccaccatgcctggccgattttttattttaacgttttgttttatcttactgtttttccttaggtgagaaaaatgtacccttccatgcctgtgctttctaaattttgggactgatacagatccacagaggccacacctaaaattaaattatcgttagtgctaaaacttaattgactgtgtatataactgtgcaattgctgttactgatataactgtttggggttcattcaacagattaaagaagcaaggtcttgcatttaacacacaaactaatgagatactgctttatacaagaattttaaaaacactgtcatatggtttagtgtagttaatgtcatgcttatgtcatataacatagcatgttagagttctctagagggacagaactaacaggatatatgtacataagaaagggagttgattggccaggtgtggcggcttatgcctgtaatcccagcactttgggaggccgagacaggtggattatctgaggtcagcagttcgagaccagcctgaccaacatggtgaaaccccatcctactaaaaaaatacaaagattagctgggcgtgttggcaggtgcctgtaatcccagctatgcaggagtctgagacagtatcacttgaacccagggggtggaggttgcggtgagccgagattgtgccactgcactccagcctgggcaacagagtgagactctgtttcaacaaacaaacaaacaaacaaaggggggggagtttattaaggataattgactcacacgttcacaaggtcaagtcccatgataggccggccgcaagttgaggagcaaggaagccagtggtggatcagcctgagtcccaaaacctcaaaagtagggaagccaacagttcagccttcagtctgtggccaaaggcctgagagcccccgacaaaccaatggtgtaagtccaagagtccaaaagctgaagaacttggagtttcatgttcaagggcaggaagcatccagcacaggagaaaaatgaaagctggaagactcagcaagtctgctcttccatcttctcttgcctgctctattctagctgggctggcaggtgattagatggtgcccacccagattgagggtggatctgcctgtcccagtccactgactcaaatgttaatctcctttggcaacaccctcacagacacaccaggaacagtaatttgcatccttcaatcctatcatgttgatgctcaatattaaccattatacattggttcaagttctttcttcagtcacaagagtaacacaggtagaagagacaaatgaataagtgccaagtcttgctgcagagtttccttcataagttttgtttgcaacctggccatttcttttctaaggtcactttgttcatcagtaagatgaactctgattctcttctaggtcctccaaactccgtaggaattgctgatttcagtttaatttgtttcagtgtctctgtctctgaaccattctagcttatagacaactcttttgttgctctcgaaacattgtagctagtttttgttcctctggttcctcagccttcactgttcgtgttccaatcttgaaacaaagtcagaaactgcttagaatatttgtaatgaagtttctgcctttcctcttgtgttttcaaaacatgttcaattctcttcttagtggtgtggataaaagcattcatatactcctgtaatcccagcactttgggaggctgagacgggtggatcacgaggtcaggagttcgagaccagcctggccaacatggtgaaaccccgtctctactaaaaataaaaaaattagccgagcatggtggcagcgcctgtaatcccagctagtcaggaggctgaggcaggagaactgcttgaacccgggaggcggaggttgcagtgagccgagatcgcgccattgcaccccagctctgggcaacagaacaagactctgtctcggaaaaaaaaaaaaaaagcattcatatacattctagcctttttctctgtgtagcaaaatcctgtttaatatcagctccgcttacttgtaacttctgtacatcatcccccacgtcttcctcatctgttcctacaaagtgctttctttctccatgctcatcagttcctgaatgctttcctcccagctcatttcctgggctgccataacctgggcctccactgccttggcaaccttcacgatgcactccctgtccacaggctccatggctggctgtcctggaacttctgaaccttgtgagtgcaatgatgcactggaagtaggtggagatgtgtgtgatctgcaggcttgggtatctggaggccagtgggcacactggacactccctgtgatctaagaacttatttaggcagatagtgagggtaaggaagtccttggtaaggttttccttttaatgaaaagcagcccccgaatcatttctttcctaacgaagtgcagcctgtaaaatcaagctgcagacatagatcagcaagctggaagcttgcaggggtgaatgccagcagctctggcaataggaaaaggccccctggaggctaggcatgttcaacatggtggctccatctcccctttttctttatcaaccacatgtacagtaaggagcaggcaacgtggcgccagccaggtagagaagccatttgtggccaggtgcggtggcacacgcctataatcccaacactttgggaggctgaggcgggcagatcacctgaggtcagaagttcaagaccagcctggccaacacgttgaaatggtgtctctactaaaaatacaaaaattagctgggtgtagtggcaggcgtctgtaatcccagctactcaggaggctgaggcaggagaatctgttgaacttgggaggtggaggttgcagtgagccgagatcacaccactgcactccagcctgggaaataggagtgaacctccatctc

SEQ ID NO: 435166 - DNA, 2556 bp, Homo sapiens
agcggaatgacaggcggcaggcggtgaccgccgcagggcctgcggagaccgtccgcctggctcgcccgagctcgcccgctgtccgccagcccgcgggagggaggagagaagcgaagcgtttccgcggttggctactcagtgtcttggtctcaagttgcctcattgcggctggcgttcccaatacagacgcatcgtttcttttttaatactccctaagaaagggaataaccttcaagctggcgggagcaatggttcacataaagaaaggcgagctgacccaggaggagaaggagctactggaagtcatcgggaaaggtactgtccaagaagctggaacattattatccagcaagaatgttcgtgtcaactgtttggacgagaatggaatgactcctctaatgcatgcagcatataaaggaaaactcgatatgtgcaaattactactgcgacatggagccgatgtaaattgtcatcagcatgaacatggatacacagccctcatgtttgctgcactttctggtaataaagacatcacatgggtaatgttagaagctggtgctgagacagatgttgtcaactctgtgggaagaacagcagctcagatggcagcctttgtgggtcaacatgattgtgtgaccataatcaacaatttctttcctcgagagagactggattattacactaagccccagggactggataaagagccaaaactgcccccaaagttggcaggcccgctgcacaaaattatcaccacaacgaatcttcatcctgtcaagatcgtgatgcttgtaaatgagaatcctctgctgacagaagaagcagccctgaataaatgctacagagtgatggatttgatttgtgagaaatgtatgaagcaaagagacatgaatgaagtattggctatgaagatgcattacataagctgtatctttcagaaatgcattaacttcttaaaagatggagagaataaactggacaccttgatcaaaagcttgttaaaaggccgagcttctgatggctttccagtgtatcaagaaaagatcattagagaaagtatcagaaaatttccttactgtgaagctacactcctccagcagctggttcgaagcattgctcctgttgaaattggttctgatcccactgcattctccgtccttacccaagccatcactggccaggtgggttttgtggatgtggaattttgcactacctgtggagaaaagggagcaagtaaaagatgttcagtttgcaaaatggtaatatattgtgatcaaacctgccagaaaacacactggtttactcataagaaaatctgtaagaatctgaaggacatttacgaaaagcaacagttggaggctgccaaagaaaagagacaagaggaaaaccacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatggtcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatcctgaacactctgaacttgacgtagtcctgcggtgatattctatctgcagtatttgtacctccagaatggcagatccctcagcaggaacaaaggcatattgacggttctctcagcgtatgcattaaaaaaggtacttcctgaaacttttgattcaataatgactaaacatactatgtacacaattactgtaaggctaattcacgtgccatactccacctgaaagcctgagttatcttgctataagcttttcatggagcacttcctttccagaaactgatttgtaactcatttagagaatgtcctggcgtcggtttttagcatatgtggtatttaaacagagctagaatgtgatgtctgaagataatgctgcatttctgggtttcttgtgtggattttaaaataaattgtgcctacaaatataaa

SEQ ID NO: 435167 - DNA, 2668 bp, Homo sapiens
agcggaatgacaggcggcaggcggtgaccgccgcagggcctgcggagaccgtccgcctggctcgcccgagctcgcccgctgtccgccagcccgcgggagggaggagagaagcgaagcgtttccgcggttggctactcagtgtcttggtctcaagttgcctcattgcggctggcgttcccaatacagacgcatcgtttcttttttaatactccctaagaaagggaataaccttcaagctggcgggagcaatggttcacataaagaaaggcgagctgacccaggaggagaaggagctactggaagtcatcgggaaaggtactgtccaagaagctggaacattattatccagcaagaatgttcgtgtcaactgtttggacgagaatggaatgactcctctaatgcatgcagcatataaaggaaaactcgatatgtgcaaattactactgcgacatggagccgatgtaaattgtcatcagcatgaacatggatacacagccctcatgtttgctgcactttctggtaataaagacatcacatgggtaatgttagaagctggtgctgagacagatgttgtcaactctgtgggaagaacagcagctcagatggcagcctttgtgggtcaacatgattgtgtgaccataatcaacaatttctttcctcgagagagactggattattacactaagccccagggactggataaagagccaaaactgcccccaaagttggcaggcccgctgcacaaaattatcaccacaacgaatcttcatcctgtcaagatcgtgatgcttgtaaatgagaatcctctgctgacagaagaagcagccctgaataaatgctacagagtgatggatttgatttgtgagaaatgtatgaagcaaagagacatgaatgaagtattggctatgaagatgcattacataagctgtatctttcagaaatgcattaacttcttaaaagatggagagaataaactggacaccttgatcaaaagcttgttaaaaggccgagcttctgatggctttccagtgtatcaagaaaagatcattagagaaagtatcagaaaatttccttactgtgaagctacactcctccagcagctggttcgaagcattgctcctgttgaaattggttctgatcccactgcattctccgtccttacccaagccatcactggccaggtgggttttgtggatgtggaattttgcactacctgtggagaaaagggagcaagtaaaagatgttcagtttgcaaaatgtgcagagaactttgaaatcatgtgagaaagtgtatgaatgcaaggatgaatgaagaattggggccaataatacaatatatgtataagggcctaccacagtgcttggcatacagtaatatattgtgatcaaacctgccagaaaacacactggtttactcataagaaaatctgtaagaatctgaaggacatttacgaaaagcaacagttggaggctgccaaagaaaagagacaagaggaaaaccacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatggtcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatcctgaacactctgaacttgacgtagtcctgcggtgatattctatctgcagtatttgtacctccagaatggcagatccctcagcaggaacaaaggcatattgacggttctctcagcgtatgcattaaaaaaggtacttcctgaaacttttgattcaataatgactaaacatactatgtacacaattactgtaaggctaattcacgtgccatactccacctgaaagcctgagttatcttgctataagcttttcatggagcacttcctttccagaaactgatttgtaactcatttagagaatgtcctggcgtcggtttttagcatatgtggtatttaaacagagctagaatgtgatgtctgaagataatgctgcatttctgggtttcttgtgtggattttaaaataaattgtgcctacaaatataaa

SEQ ID NO: 435168 - DNA, 1957 bp, Homo sapiens
  misc_feature (1957)..(1957): n is a, c, g, or t
attaaatttcagaactacaggtgaaattacagagtatatttataaatcattcattaaattgcagatctaatatacagatcaaatttctacaagtgtcatagcagtgaattttgtatttttttttctccatccctcttgaggttttgtgacccattttcatcagaaatagtgagttgcttcagcagtgattatcagattggagaggagaactgcccccaccctcatgcctcattccagagaatgtatcatatgttctgggggagtgcatgtaatttgaaaaagatgcctcggttattctgataccaggcatttctgcctccatctctcaaggaaccatatccgctttactactgggttgagatatactctcagtggaattaaatggtttgtacacaattaaaccatttatccttaagagaatagtcaggctttctgactgccatgccttctcttgttttcttgaccaaacttttttattctatgtgctaaggacagaaagtaacaaatgttcattactaacacactattgagggagaataagattgtcagtagaatgggcactcccagttgttaagcatcattcatgcaccaaacactgctctaaatgttacagacaactttattcttcaccaatgtaggatagcctttattacctgcatattatagacaagggaaacaacttcatgcaggcaattacctctccaaggacatcaaataaattcacagaaaagctgtattcaaatacaggctttgtcaaatcccaagcaacaatcttgatttagagatggctttggagccagcggcctgagttcaaatgctggttctgctgtttcactagccaggaaacttgcagcaagctaccaaacctctctcttctcagttttctcatttgtaaaataacgttagcgatgacagtagagatactaatatacctcatgtagttgataggaagattaaataatacatgtaaagcattgagaagagtgtctgacacatggtaggaacaaaataacttcttctttttttaatcagacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatggtcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatctgaccctgaatgggtatcgggggaattaatgcgattgccccaaagggccccccagacacgtttgcggtcccggtttaaaagccgcacggtgacacaaaatcagaggggagtgaccaccgcatttgatggcacaaaaagcgtgtgtatatatgtctgtatcaccagaaacaaatcacctggn

SEQ ID NO: 435169 - DNA, 2420 bp, Homo sapiens
agcggaatgacaggcggcaggcggtgaccgccgcagggcctgcggagaccgtccgcctggctcgcccgagctcgcccgctgtccgccagcccgcgggagggaggagagaagcgaagcgtttccgcggttggctactcagtgtcttggtctcaagttgcctcattgcggctggcgttcccaatacagacgcatcgtttcttttttaatactccctaagaaagggaataaccttcaagctggcgggagcaatggttcacataaagaaaggcgagctgacccaggaggagaaggagctactggaagtcatcgggaaaggtactgtccaagaagctggaacattattatccagcaagaatgttcgtgtcaactgtttggacgagaatggaatgactcctctaatgcatgcagcatataaaggaaaactcgatatgtgcaaattactactgcgacatggagccgatgtaaattgtcatcagcatgaacatggatacacagccctcatgtttgctgcactttctggtaataaagacatcacatgggtaatgttagaagctggtgctgagacagatgttgtcaactctgtgggaagaacagcagctcagatggcagcctttgtgggtcaacatgattgtgtgaccataatcaacaatttctttcctcgagagagactggattattacactaagccccagggactggataaagagccaaaactgcccccaaagttggcaggcccgctgcacaaaattatcaccacaacgaatcttcatcctgtcaagatcgtgatgcttgtaaatgagaatcctctgctgacagaagaagcagccctgaataaatgctacagagtgatggatttgatttgtgagaaatgtatgaagcaaagagacatgaatgaagtattggctatgaagatgcattacataagctgtatctttcagaaatgcattaacttcttaaaagatggagagaataaactggacaccttgatcaaaagggttctgatcccactgcattctccgtccttacccaagccatcactggccaggtgggttttgtggatgtggaattttgcactacctgtggagaaaagggagcaagtaaaagatgttcagtttgcaaaatggtaatatattgtgatcaaacctgccagaaaacacactggtttactcataagaaaatctgtaagaatctgaaggacatttacgaaaagcaacagttggaggctgccaaagaaaagagacaagaggaaaaccacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatggtcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatcctgaacactctgaacttgacgtagtcctgcggtgatattctatctgcagtatttgtacctccagaatggcagatccctcagcaggaacaaaggcatattgacggttctctcagcgtatgcattaaaaaaggtacttcctgaaacttttgattcaataatgactaaacatactatgtacacaattactgtaaggctaattcacgtgccatactccacctgaaagcctgagttatcttgctataagcttttcatggagcacttcctttccagaaactgatttgtaactcatttagagaatgtcctggcgtcggtttttagcatatgtggtatttaaacagagctagaatgtgatgtctgaagataatgctgcatttctgggtttcttgtgtggattttaaaataaattgtgcctacaaatataaa

SEQ ID NO: 435170 - DNA, 3354 bp, Homo sapiens
agcggaatgacaggcggcaggcggtgaccgccgcagggcctgcggagaccgtccgcctggctcgcccgagctcgcccgctgtccgccagcccgcgggagggaggagagaagcgaagcgtttccgcggttggctactcagtgtcttggtctcaagttgcctcattgcggctggcgttcccaatacagacgcatcgtttcttttttaatactccctaagaaagggaataaccttcaagctggcgggagcaatggttcacataaagaaaggcgagctgacccaggaggagaaggagctactggaagtcatcgggaaaggtactgtccaagaagctggaacattattatccagcaagaatgttcgtgtcaactgtttggacgagaatggaatgactcctctaatgcatgcagcatataaaggaaaactcgatatgtgcaaattactactgcgacatggagccgatgtaaattgtcatcagcatgaacatggatacacagccctcatgtttgctgcactttctggtaataaagacatcacatgggtaatgttagaagctggtgctgagacagatgttgtcaactctgtgggaagaacagcagctcagatggcagcctttgtgggtcaacatgattgtgtgaccataatcaacaatttctttcctcgagagagactggattattacactaagccccagggactggataaagagccaaaactgcccccaaagttggcaggcccgctgcacaaaattatcaccacaacgaatcttcatcctgtcaagatcgtgatgcttgtaaatgagaatcctctgctgacagaagaagcagccctgaataaatgctacagagtgatggatttgatttgtgagaaatgtatgaagcaaagagacatgaatgaagtattggctatgaagatgcattacataagctgtatctttcagaaatgcattaacttcttaaaagatggagagaataaactggacaccttgatcaaaagcttgttaaaaggccgagcttctgatggctttccagtgtatcaagaaaagatcattagagaaagtatcagaaaatttccttactgtgaagctacactcctccagcagctggttcgaagcattgctcctgttgaaattggttctgatcccactgcattctccgtccttacccaagccatcactggccaggtgggttttgtggatgtggaattttgcactacctgtggagaaaagggagcaagtaaaagatgttcagtttgcaaaatggtaatatattgtgatcaaacctgccagaaaacacactggtttactcataagaaaatctgtaagaatctgaaggacatttacgaaaagcaacagttggaggctgccaaagaaaagagacaagaggaaaaccacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatggtcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatcctgaacactctgaacttgacgtagtcctgcggtgatattctatctgcagtatttgtacctccagaatggcagatccctcagcaggaacaaaggcatattgacggttctctcagcgtatgcattaaaaaaggtacttcctgaaacttttgattcaataatgactaaacatactatgtacacaattactgtaaggctaattcacgtgccatactccacctgaaagcctgagttatcttgctataagcttttcatggagcacttcctttccagaaactgatttgtaactcatttagagaatgtcctggcgtcggtttttagcatatgtggtatttaaacagagctagaatgtgatgtctgaagataatgctgcatttctgggtttcttgtgtggattttaaaataaattgtgcctacaaatataaaaaaaaaaaaaaaaaaaaagaaaaaaccaaaaaaacagaaaaaaaaaccaacaaacaaagcaagacaagaaaaaaaaaaaaagagggagggagacggcagccgaggaaggaagcaccccggggggacgaccagaagcggggcgccgcccagttctggcgggcagggagggccgccccacggcggggccgcccagccaccgcgcggcgccgcccgcccgccccgcccccccgccgggcgcggcaaaccgacccgcccagccggcgcacatcggtctaggcaagcgacccgactgacggagggaggacaacacactagtgcgccaaaacactccccagaagaaaaaattctgagcgacccaccagtgcgaacatagaacatctaccagggcggtctgagagccaaaacagacgccgaaaaagtaggaggcaagacaagtcacgctagccacgaggaagaacacagaacaaaagtatgagccaggcagcgcaaataggcgacgtgacggacttgcgtatgcgtgcgggaggccaggtgagtagccggagtgcgacttggacgcgcagtagcaaccacaaaaaaggggaggagtgacgcggcagagagaaagagcgaagaagaacaacgaagacaaagacgactagaggagaccaagagccgcaaggacagaacagcagacagaagcagtcaacacaaaaggagatcggcggccggaggagaggaaaaagaacgagggaggactgtatagaatgggcacgagagacagtagacgcgaagcgtacaaagaagagcgagcatcaa

SEQ ID NO: 435171 - DNA, 2314 bp, Homo sapiens
  misc_feature (2314)..(2314): n is a, c, g, or t
agcggaatgacaggcggcaggcggtgaccgccgcagggcctgcggagaccgtccgcctggctcgcccgagctcgcccgctgtccgccagcccgcgggagggaggagagaagcgaagcgtttccgcggttggctactcagtgtcttggtctcaagttgcctcattgcggctggcgttcccaatacagacgcatcgtttcttttttaatactccctaagaaagggaataaccttcaagctggcgggagcaatggttcacataaagaaaggcgagctgacccaggaggagaaggagctactggaagtcatcgggaaaggtactgtccaagaagctggaacattattatccagcaagaatgttcgtgtcaactgtttggacgagaatggaatgactcctctaatgcatgcagcatataaaggaaaactcgatatgtgcaaattactactgcgacatggagccgatgtaaattgtcatcagcatgaacatggatacacagccctcatgtttgctgcactttctggtaataaagacatcacatgggtaatgttagaagctggtgctgagacagatgttgtcaactctgtgggaagaacagcagctcagatggcagcctttgtgggtcaacatgattgtgtgaccataatcaacaatttctttcctcgagagagactggattattacactaagccccagggactggataaagagccaaaactgcccccaaagttggcaggcccgctgcacaaaattatcaccacaacgaatcttcatcctgtcaagatcgtgatgcttgtaaatgagaatcctctgctgacagaagaagcagccctgaataaatgctacagagtgatggatttgatttgtgagaaatgtatgaagcaaagagacatgaatgaagtattggctatgaagatgcattacataagctgtatctttcagaaatgcattaacttcttaaaagatggagagaataaactggacaccttgatcaaaagcttgttaaaaggccgagcttctgatggctttccagtgtatcaagaaaagatcattagagaaagtatcagaaaatttccttactgtgaagctacactcctccagcagctggttcgaagcattgctcctgttgaaattggttctgatcccactgcattctccgtccttacccaagccatcactggccaggtgggttttgtggatgtggaattttgcactacctgtggagaaaagggagcaagtaaaagatgttcagtttgcaaaatggtaatatattgtgatcaaacctgccagaaaacacactggtttactcataagaaaatctgtaagaatctgaaggacatttacgaaaagcaacagttggaggctgccaaagaaaagagacaagaggaaaaccacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatggtcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatctgaccctgaatgggtatcgggggaattaatgcgattgccccaaagggccccccagacacgtttgcggtcccggtttaaaagccgcacggtgacacaaaatcagaggggagtgaccaccgcatttgatggcacaaaaagcgtgtgtatatatgtctgtatcaccagaaacaaatcacctggn

SEQ ID NO: 435172 - DNA, 2199 bp, Homo sapiens
attaaatttcagaactacaggtgaaattacagagtatatttataaatcattcattaaattgcagatctaatatacagatcaaatttctacaagtgtcatagcagtgaattttgtatttttttttctccatccctcttgaggttttgtgacccattttcatcagaaatagtgagttgcttcagcagtgattatcagattggagaggagaactgcccccaccctcatgcctcattccagagaatgtatcatatgttctgggggagtgcatgtaatttgaaaaagatgcctcggttattctgataccaggcatttctgcctccatctctcaaggaaccatatccgctttactactgggttgagatatactctcagtggaattaaatggtttgtacacaattaaaccatttatccttaagagaatagtcaggctttctgactgccatgccttctcttgttttcttgaccaaacttttttattctatgtgctaaggacagaaagtaacaaatgttcattactaacacactattgagggagaataagattgtcagtagaatgggcactcccagttgttaagcatcattcatgcaccaaacactgctctaaatgttacagacaactttattcttcaccaatgtaggatagcctttattacctgcatattatagacaagggaaacaacttcatgcaggcaattacctctccaaggacatcaaataaattcacagaaaagctgtattcaaatacaggctttgtcaaatcccaagcaacaatcttgatttagagatggctttggagccagcggcctgagttcaaatgctggttctgctgtttcactagccaggaaacttgcagcaagctaccaaacctctctcttctcagttttctcatttgtaaaataacgttagcgatgacagtagagatactaatatacctcatgtagttgataggaagattaaataatacatgtaaagcattgagaagagtgtctgacacatggtaggaacaaaataacttcttctttttttaatcagacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatggtcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatcctgaacactctgaacttgacgtagtcctgcggtgatattctatctgcagtatttgtacctccagaatggcagatccctcagcaggaacaaaggcatattgacggttctctcagcgtatgcattaaaaaaggtacttcctgaaacttttgattcaataatgactaaacatactatgtacacaattactgtaaggctaattcacgtgccatactccacctgaaagcctgagttatcttgctataagcttttcatggagcacttcctttccagaaactgatttgtaactcatttagagaatgtcctggcgtcggtttttagcatatgtggtatttaaacagagctagaatgtgatgtctgaagataatgctgcatttctgggtttcttgtgtggattttaaaataaattgtgcctacaaatataaa

SEQ ID NO: 435173 - DNA, 2040 bp, Homo sapiens
attgcccactagtagtaagtttcacacatttggtttttcttaatactttgattcaattgctgcatgtgtgtttcttaacaaatttggaacataccaattataatggtgataatttatttgaattacaagccaacatcaagtaaatgagtttaaatatattgtctttaaaatacttagattgtactaaacttttcagaattaagacagttaaacatttttgatgtgccctataattgtctcatggaatatgaatattttctggatgtcagttctcagaaaaaaattctgctctggagttattgtcctaaatctgaaacgctatgggcttactgaattatccttattggaaaaatactttttttctagattaagggtgtttttttctctttaattatctggacatatgactgacttttcatatgttttgtacagaaaatggtatattctaaaagatttttgtcattttgtcttaaagcctgtgtaatctatagccttaatgatttcttcctttttgtgtcacattgtaggacggcagtgtccgtgggctgatacctctgtagtgtttccatggtgatttcagaatttgttttttctcctcttcatgcccactctagggttctgatcccactgcattctccgtccttacccaagccatcactggccaggtgggttttgtggatgtggaattttgcactacctgtggagaaaagggagcaagtaaaagatgttcagtttgcaaaatggtaatatattgtgatcaaacctgccagaaaacacactggtttactcataagaaaatctgtaagaatctgaaggacatttacgaaaagcaacagttggaggctgccaaagaaaagagacaagaggaaaaccacggcaaacttgatgtcaattctaactgtgttaatgaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatggtcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatcctgaacactctgaacttgacgtagtcctgcggtgatattctatctgcagtatttgtacctccagaatggcagatccctcagcaggaacaaaggcatattgacggttctctcagcgtatgcattaaaaaaggtacttcctgaaacttttgattcaataatgactaaacatactatgtacacaattactgtaaggctaattcacgtgccatactccacctgaaagcctgagttatcttgctataagcttttcatggagcacttcctttccagaaactgatttgtaactcatttagagaatgtcctggcgtcggtttttagcatatgtggtatttaaacagagctagaatgtgatgtctgaagataatgctgcatttctgggtttcttgtgtggattttaaaataaattgtgcctacaaatataaa

SEQ ID NO: 435174 - DNA, 1683 bp, Homo sapiens
actgaccaccccagaggccgccccattagctcgcttgctttgggcggcgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggcgtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgc

SEQ ID NO: 435175 - DNA, 1007 bp, Homo sapiens
gtgcatcttacaattggtatatcttggatttgatgaaatacaataagtattaatactagaggggaaactgtgaagctcctaagtacctggcatttctaaaagccccatttggggagagtggacccaagcctgagccatctagcttgagtgaaactgatcctgtgtcctgctgttccagtcatgattgactggacctggatcattgtgtgagccaagggctttcatgtgttctctgcatctgagggagcccaatggctgtgagataccataacgattgagggttttccatatcactccgtcacaaactcatccaatcagatcctgttttgcagtggatggaggcaacaaacatctgtggttcactcagcctcaatttccaattgtctctgctgcccagaaggccttgtgtaatctttatctgtgagaggatctctgtgagatagatatgataacaggcactttatggatgagaaacaaaggcttagataggtcagctgacgtagggcctgggagctgatgtgagttagagctaatgggccatgctttctgcacagcactgcaccatacatttatatgtgtaacctcaataagtgactgttttgtgggagtttgaattatttatgaacagtaggataaacaaccaaataaccagagattcttattatttattcaggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgc

SEQ ID NO: 435176 - DNA, 2244 bp, Homo sapiens
actgaccaccccagaggccgccccattagctcgcttgctttgggcggcgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggcgtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgcaaaaatgtttttaaaatgtgtgccttttattacctatcagtctatgttttgggagaaatgggaagcaacagatcactgtgtcctgatgtgcaggacgcatgttaccacactcacaaatgcctaatattggtctttatgtggccattgagtcctgttgactttccactcatgtgctttttactctagcattatggaatctgggctgtacttgagtatggaaattctcttatagacttagttttagtactctattacacctttactaagccacataaaagtaatctgtttgtgtgtaactgccagatataccacctggaattccaagtaagataaggaagaggatgacatttaaaagagaatggaattttgagagtaggaatgcaaggaagacagcatgaacatatttttttcagtgcaaataattttttcgtaacaaagaaacgaacaactttggtatgatcttaagcaaaaatactcactgaaatagtatgtggatgaattcacctacttacaattttatggtttctttgtaaataataaatgtgaatctcaatcctgctt

SEQ ID NO: 435177 - DNA, 2309 bp, Homo sapiens
actgaccaccccagaggccgccccattagctcgcttgctttgggcggcgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggcgtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacagaatgtgtgcatgaagaggaaaggctgtttgggaggtttcctgatgtaggacccccgcatgccgcggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgcaaaaatgtttttaaaatgtgtgccttttattacctatcagtctatgttttgggagaaatgggaagcaacagatcactgtgtcctgatgtgcaggacgcatgttaccacactcacaaatgcctaatattggtctttatgtggccattgagtcctgttgactttccactcatgtgctttttactctagcattatggaatctgggctgtacttgagtatggaaattctcttatagacttagttttagtactctattacacctttactaagccacataaaagtaatctgtttgtgtgtaactgccagatataccacctggaattccaagtaagataaggaagaggatgacatttaaaagagaatggaattttgagagtaggaatgcaaggaagacagcatgaacatatttttttcagtgcaaataattttttcgtaacaaagaaacgaacaactttggtatgatcttaagcaaaaatactcactgaaatagtatgtggatgaattcacctacttacaattttatggtttctttgtaaataataaatgtgaatctcaatcctgctt

SEQ ID NO: 435178 - DNA, 1072 bp, Homo sapiens
ccagggctcagaggggagcctcagattactccgtgaactctcatcttacgctttttcaagcaaagcgtctaagctgaaatccacaactcatggttcccaattttcaaaagtctgaagcaataattcactgaattcagtatttcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgc

SEQ ID NO: 435179 - DNA, 1568 bp, Homo sapiens
gtgcatcttacaattggtatatcttggatttgatgaaatacaataagtattaatactagaggggaaactgtgaagctcctaagtacctggcatttctaaaagccccatttggggagagtggacccaagcctgagccatctagcttgagtgaaactgatcctgtgtcctgctgttccagtcatgattgactggacctggatcattgtgtgagccaagggctttcatgtgttctctgcatctgagggagcccaatggctgtgagataccataacgattgagggttttccatatcactccgtcacaaactcatccaatcagatcctgttttgcagtggatggaggcaacaaacatctgtggttcactcagcctcaatttccaattgtctctgctgcccagaaggccttgtgtaatctttatctgtgagaggatctctgtgagatagatatgataacaggcactttatggatgagaaacaaaggcttagataggtcagctgacgtagggcctgggagctgatgtgagttagagctaatgggccatgctttctgcacagcactgcaccatacatttatatgtgtaacctcaataagtgactgttttgtgggagtttgaattatttatgaacagtaggataaacaaccaaataaccagagattcttattatttattcaggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgcaaaaatgtttttaaaatgtgtgccttttattacctatcagtctatgttttgggagaaatgggaagcaacagatcactgtgtcctgatgtgcaggacgcatgttaccacactcacaaatgcctaatattggtctttatgtggccattgagtcctgttgactttccactcatgtgctttttactctagcattatggaatctgggctgtacttgagtatggaaattctcttatagacttagttttagtactctattacacctttactaagccacataaaagtaatctgtttgtgtgtaactgccagatataccacctggaattccaagtaagataaggaagaggatgacatttaaaagagaatggaattttgagagtaggaatgcaaggaagacagcatgaacatatttttttcagtgcaaataattttttcgtaacaaagaaacgaacaactttggtatgatcttaagcaaaaatactcactgaaatagtatgtggatgaattcacctacttacaattttatggtttctttgtaaataataaatgtgaatctcaatcctgctt

SEQ ID NO: 435180 - DNA, 1814 bp, Homo sapiens
actgaccaccccagaggccgccccattagctcgcttgctttgggcggcgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggcgtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggtaaagggtcagctttgcttctgaatacgctgtcttgaagccattgctgcattttcttgtgttaattttttttatgttatgctgctttaattcttgagagaatgaacagttttatattctgatctttggagttggaaaatgcccttaatttctgttccctgcagtaatttgtgtactcctacctcagccttctccacccctatttcccatttaatggtaaaatgctgatggaagaggctcagcagaaagacaggtatatgttcacagctcattacagaatatcattaaggaatagggaaatgaaggtgattgattctcagagttatgtacattctcagagttatgtatttattttttctgtctcagatagaagggaaaatgtttaaattattcaacatcagcttgggaaatgtttaaattgaatgtcttttatcaaatgtatttttaaagtataattgaagtttg

SEQ ID NO: 435181 - DNA, 418 bp, Homo sapiens
gttttgagactgggagtcaagaggtggacctgaacttgccagcattctgcctccctttgagtcctctgggagatatttcttggtgtcaccttgtgctgctttcttctgctataatagtttcatacttaatatgagccaaagaataaacagactcaaaggctaatgaagccaccatttaaaagataactttctcttttctcttaggatacctgggatgaactcctaattggtagtgtagaagtgaaaaaggtaatggcatgccccaggtaaggagcctagctagaccccaggactgtggtgtggcccattcattggttcctaagcatcacctaacccttggttactgcataacaggtgtattttgacaacggtggacccagacactggagtcatagacaggaaacagccactggacacc

SEQ ID NO: 435182 - DNA, 189 bp, Homo sapiens
aaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaa

SEQ ID NO: 435183 - DNA, 1394 bp, Homo sapiens
actgaccaccccagaggccgccccattagctcgcttgctttgggcggcgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggcgtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgc

SEQ ID NO: 435184 - DNA, 1733 bp, Homo sapiens
ggaagcgggaggaactccgtcgtcctccgcgcgcgcctgcccgcggctgcgcagcggcaacctgcgggacagttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgcaaaaatgtttttaaaatgtgtgccttttattacctatcagtctatgttttgggagaaatgggaagcaacagatcactgtgtcctgatgtgcaggacgcatgttaccacactcacaaatgcctaatattggtctttatgtggccattgagtcctgttgactttccactcatgtgctttttactctagcattatggaatctgggctgtacttgagtatggaaattctcttatagacttagttttagtactctattacacctttactaagccacataaaagtaatctgtttgtgtgtaactgccagatataccacctggaattccaagtaagataaggaagaggatgacatttaaaagagaatggaattttgagagtaggaatgcaaggaagacagcatgaacatatttttttcagtgcaaataattttttcgtaacaaagaaacgaacaactttggtatgatcttaagcaaaaatactcactgaaatagtatgtggatgaattcacctacttacaattttatggtttctttgtaaataataaatgtgaatctcaatcctgctt

SEQ ID NO: 435185 - DNA, 1559 bp, Homo sapiens
  misc_feature (1529)..(1529): n is a, c, g, or t
actgaccaccccagaggccgccccattagctcgcttgctttgggcggcgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggcgtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagagggggggttgacncggccgcgaatttagtagtagtagtcgacc

SEQ ID NO: 435186 - DNA, 1444 bp, Homo sapiens
  misc_feature (64)..(64): n is a, c, g, or t
  misc_feature (1161)..(1161): n is a, c, g, or t
  misc_feature (1303)..(1303): n is a, c, g, or t
  misc_feature (1309)..(1309): n is a, c, g, or t
tggggcgggctgtgagcggaccgcgagcgctgggcgggtccgcggcgcggtcggtcggcgcctnttctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatgngggggctctcgggcaccacgtgtaaggtgatgtgcccatatcaagaagtcagagaaaacactttcctggttaaaaagaaacatttcagatgcatgatcagctgtgtgttcatcctgggagggccatccacttttacagaccntgccgnaaatcattctaaacacttgatcgtctcctgttaaaactccaactctttataagtggccacatcgtgcggaggaagtctcatttcccacacatgtgaagttacaaaggtataatagtctataacaaaagacacacc

SEQ ID NO: 435187 - DNA, 1175 bp, Homo sapiens
  misc_feature (64)..(64): n is a, c, g, or t
tggggcgggctgtgagcggaccgcgagcgctgggcgggtccgcggcgcggtcggtcggcgcctnttctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaattta

SEQ ID NO: 435188 - DNA, 1418 bp, Homo sapiens
  misc_feature (64)..(64): n is a, c, g, or t
  misc_feature (1135)..(1135): n is a, c, g, or t
  misc_feature (1277)..(1277): n is a, c, g, or t
  misc_feature (1283)..(1283): n is a, c, g, or t
tggggcgggctgtgagcggaccgcgagcgctgggcgggtccgcggcgcggtcggtcggcgcctnttctcgggctgtttggcggcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatgngggggctctcgggcaccacgtgtaaggtgatgtgcccatatcaagaagtcagagaaaacactttcctggttaaaaagaaacatttcagatgcatgatcagctgtgtgttcatcctgggagggccatccacttttacagaccntgccgnaaatcattctaaacacttgatcgtctcctgttaaaactccaactctttataagtggccacatcgtgcggaggaagtctcatttcccacacatgtgaagttacaaaggtataatagtctataacaaaagacacacc

SEQ ID NO: 435189 - DNA, 1035 bp, Homo sapiens
  misc_feature (752)..(752): n is a, c, g, or t
  misc_feature (894)..(894): n is a, c, g, or t
  misc_feature (900)..(900): n is a, c, g, or t
agtcgacggagactctcgtcatgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatgngggggctctcgggcaccacgtgtaaggtgatgtgcccatatcaagaagtcagagaaaacactttcctggttaaaaagaaacatttcagatgcatgatcagctgtgtgttcatcctgggagggccatccacttttacagaccntgccgnaaatcattctaaacacttgatcgtctcctgttaaaactccaactctttataagtggccacatcgtgcggaggaagtctcatttcccacacatgtgaagttacaaaggtataatagtctataacaaaagacacacc

SEQ ID NO: 435190 - DNA, 1445 bp, Homo sapiens
  misc_feature (64)..(64): n is a, c, g, or t
  misc_feature (1162)..(1162): n is a, c, g, or t
  misc_feature (1304)..(1304): n is a, c, g, or t
  misc_feature (1310)..(1310): n is a, c, g, or t
tggggcgggctgtgagcggaccgcgagcgctgggcgggtccgcggcgcggtcggtcggcgcctnttctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctcctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatgngggggctctcgggcaccacgtgtaaggtgatgtgcccatatcaagaagtcagagaaaacactttcctggttaaaaagaaacatttcagatgcatgatcagctgtgtgttcatcctgggagggccatccacttttacagaccntgccgnaaatcattctaaacacttgatcgtctcctgttaaaactccaactctttataagtggccacatcgtgcggaggaagtctcatttcccacacatgtgaagttacaaaggtataatagtctataacaaaagacacacc

SEQ ID NO: 435191 - DNA, 1324 bp, Homo sapiens
  misc_feature (64)..(64): n is a, c, g, or t
  misc_feature (1041)..(1041): n is a, c, g, or t
  misc_feature (1183)..(1183): n is a, c, g, or t
  misc_feature (1189)..(1189): n is a, c, g, or t
tggggcgggctgtgagcggaccgcgagcgctgggcgggtccgcggcgcggtcggtcggcgcctnttctcgggctgtttggcggacgaagcttcacaaaagatgtctaaggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctcctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatgngggggctctcgggcaccacgtgtaaggtgatgtgcccatatcaagaagtcagagaaaacactttcctggttaaaaagaaacatttcagatgcatgatcagctgtgtgttcatcctgggagggccatccacttttacagaccntgccgnaaatcattctaaacacttgatcgtctcctgttaaaactccaactctttataagtggccacatcgtgcggaggaagtctcatttcccacacatgtgaagttacaaaggtataatagtctataacaaaagacacacc

SEQ ID NO: 435192 - DNA, 448 bp, Homo sapiens
taaatgcagatttcagcgctatctaataaacaaccaaagcataagccagacacaattaaatatgtttttcattgtaagtaccatcattactgatttaatagcaattaatattttctttctaatttaaaaatcctcagaaagcaaaaaggcttcaagaaaaagctatagaagcctccagataccataaacgaccacaaaatgcaatatttcaccaaacacatattaaaggccttaacacaatggtaagattctttctccataacattttcttaatagacattaaatttagagtgtttgaacaactgtgcaaatatactgaaaaccattgaattttacccattaaatggatggattgtgtggtattgaattatatctcaataaaactgttcaaaaaaaattttaaatttaaaaattagaagttaaaaaaattaataaaaaaaaaacttag

SEQ ID NO: 435193 - DNA, 529 bp, Homo sapiens
caatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctgtaagcgtatgtggttagataggaatgttcttttaatcttaaaatgacagccagtgacataactaacatctttgtttgaatctgtgttcaattatgttttagattcatgtaatggctatgtttcaggacatcttttttgttccatggtataaatgaatctgcacaataacaagccacacttttctatgtggaaggctcttgaagtagcttcttaacactaaaatataacttggaatatagataaagtaaaattagactttagaa

SEQ ID NO: 435194 - DNA, 3063 bp, Homo sapiens
caatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctggctttgaaggaagtatttaaaaatctgtttatgagaggtttcagtcattatgaccgtcagcttagaaatgacatattagtgatcactacaattatagctcaaaatcctgaagcaccaatgattgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccatggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgatacaaaaaaacctctatttactagctttcaagaagagcaaaaaatcatcccactgcctgctaactgcccatctattgcggttatggatgtttctgagaatattagagcaaaaatttatgctatattgggcaaactagattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaaggcttcaagaaaaagctatagaagcctccagataccataaacgaccacaaaatgcaatatttcaccaaacacatattaaaggccttaacacaatggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatctcaggacccctgattgcccacatgcctacggtagtcctgagccattcaccatgactttggccatggctgagtactgcctattcctggagccagaagcagggcaactccatccaaaacatatggatagagtggggaatcagggtactattatcagaagcaagtatatatgaatattgggcagcaagataaacaataactctgcaacaagtatgttggtcaaaataaaattatgttttctctgctataaaagcaaatgttagtcatgagccaaatggtaaaaaagaaaaaaaaatgcagctggttttactcttaatatataaatatacaaagcaaactctaatgctact

SEQ ID NO: 435195 - DNA, 2958 bp, Homo sapiens
caatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctggctttgaaggaagtatttaaaaatctgtttatgagaggtttcagtcattatgaccgtcagcttagaaatgacatattagtgatcactacaattatagctcaaaatcctgaagcaccaatgattgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccatggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgatacaaaaaaacctctatttactagctttcaagaagagcaaaaaatcatcccactgcctgctaactgcccatctattgcggttatggatgtttctgagaatattagagcaaaaatttatgctatattgggcaaactagattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaaggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatctcaggacccctgattgcccacatgcctacggtagtcctgagccattcaccatgactttggccatggctgagtactgcctattcctggagccagaagcagggcaactccatccaaaacatatggatagagtggggaatcagggtactattatcagaagcaagtatatatgaatattgggcagcaagataaacaataactctgcaacaagtatgttggtcaaaataaaattatgttttctctgctataaaagcaaatgttagtcatgagccaaatggtaaaaaagaaaaaaaaatgcagctggttttactcttaatatataaatatacaaagcaaactctaatgctact

SEQ ID NO: 435196 - DNA, 1190 bp, Homo sapiens
atagaaatagaattcaaacctacttttcctggctccgatgcccttatctttctattataccataactgcctcctagttattcattacatttgtgtcttttcaaaagtaagctgaaggatgaatgagtttttctcttgttgaaaattgtgtaaatggacttttagatatttaccttttgcctttttaggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatctcaggacccctgattgcccacatgcctacggtagtcctgagccattcaccatgactttggccatggctgagtactgcctattcctggagccagaagcagggcaactccatccaaaacatatggatagagtggggaatcagggtactattatcagaagcaagtatatatgaatattgggcagcaagataaacaataactctgcaacaagtatgttggtcaaaataaaattatgttttctctgctataaaagcaaatgttagtcatgagccaaatggtaaaaaagaaaaaaaaatgcagctggttttactcttaatatataaatatacaaagcaaactctaatgctact

SEQ ID NO: 435197 - DNA, 1435 bp, Homo sapiens
caatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctggctttgaaggaagtatttaaaaatctgtttatgagaggtttcagtcattatgaccgtcagcttagaaatgacatattagtgatcactacaattatagctcaaaatcctgaagcaccaatgattgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccatggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggtatgtatgcctgtgaaagttttgttcaggtctcccagtcacctaacactataaactatttttggaagtctctataattgtatttaattttgtgaaaatttaatatttttgttaataattagagcataattatataaagtaaaaggtacagaatatacaacagtatacacccatttaactcatacccccaacatggtgaaacctcatatctactaaaaatacaaaaattagccaggcgttgtggtgtgcgcctgtaatctcagttactcgggaggctgaggcacgagaattgcttgaacctaggaggtaggttacagtgagcccagatctcaccactgcactccagcctaggtgacgcagtgagactccatctg

SEQ ID NO: 435198 - DNA, 420 bp, Homo sapiens
aactactgttctgttttctattcctataggttggttttccctattctttaagtttatatcaatggaatcgcacaatatttactcttttatgtctggattctgtcacccagcatcatattttagaaatatatccatgttggccgggcatggtggctcaggcctgtaatctcagcactttgggaggctgaggcaggtggattgcctgaggtcaggagtttgagaccagcctggccaacatggtgaaacctcatatctactaaaaatacaaaaattagccaggcgttgtggtgtgcgcctgtaatctcagttactcgggaggctgaggcacgagaattgcttgaacctaggaggtaggttacagtgagcccagatctcaccactgcactccagcctaggtgacgcagtgagactccatctgaa

SEQ ID NO: 435199 - DNA, 2143 bp, Homo sapiens
caatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctggctttgaaggaagtatttaaaaatctgtttatgagaggtttcagtcattatgaccgtcagcttagaaatgacatattagtgatcactacaattatagctcaaaatcctgaagcaccaatgattgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccatggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaaggcttcaagaaaaagctatagaagcctccagataccataaacgaccacaaaatgcaatatttcaccaaacacatattaaaggccttaacacaatggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctg

SEQ ID NO: 435200 - DNA, 2865 bp, Homo sapiens
caatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctggctttgaaggaagtatttaaaaatctgtttatgagaggtttcagtcattatgaccgtcagcttagaaatgacatattagtgatcactacaattatagctcaaaatcctgaagcaccaatgattgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccatggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgatacaaaaaaacctctatttactagctttcaagaagagcaaaaaatcatcccactgcctgctaactgcccatctattgcggttatggatgtttctgagaatattagagcaaaaatttatgctatattgggcaaactagattttgaaaatttacctggcctatctgctgaagattttgtcaccctttgtatcatacatagatatcttgattttaaaatacaggccacgcacaagcaaagagagctggctaataaatcatgggaagatttcttggctagaacatcaaacgctaaaacgttaaagaaagcaaaaaggcttcaagaaaaagctatagaagcctccagataccataaacgaccacaaaatgcaatatttcaccaaacacatattaaaggccttaacacaatggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatctcaggacccctgattgcccacatgcctacggtagtcctgagccattcaccatgactttggccatggctgagtactgcctattcctggagccagaagcagggcaactccatccaaaacatatggatagagtggggaatcagggtactattatcagaagcaagtatatatgaatattgggcagcaagataaacaataactctgcaacaagtatgttggtcaaaataaaattatgttttctctgctataaaagcaaatgttagtcatgagccaaatggtaaaaaagaaaaaaaaatgcagctggttttactcttaatatataaatatacaaagcaaactctaatgctact

SEQ ID NO: 435201 - DNA, 377 bp, Homo sapiens
  misc_feature (6)..(6): n is a, c, g, or t
  misc_feature (39)..(40): n is a, c, g, or t
cccccnccccctttttaaaacaggtttctttttctccannaaaaagcggaattccctttgtcgctgggtccctcaaagttttcaagtaccagccccccaaatcatactgtgattttatttttaatatggatatgctatcaaactgtgatacacttataattcactggtcctgcatcaggagatggagtggggaaaactgtatttaatacagtttgtatctgaataatctgtatggtttatacagtttgtgttgttcagagatgtttaaagtttgatctttgtttttctaaagattaaaaaagcacttgccccactgtaaatatacagcatgtaaaatttctatagtatataaatggcagcaaatcccaaaaaaaaaa

SEQ ID NO: 435202 - DNA, 554 bp, Homo sapiens
aaagattttatgctcacagggcacaccatgcagggccatgtggtgaggaagcagaagacaggagcaaggggaaggcattattggccagagccttcgttgaggtttccgtgggaaaagcagggtagggcagggggaagaatttgggattggctggtttgaataatttttgtgggctctgagccacaggtgtggtccagagttgcctggcacctggccctgagatgattagggcagaggagttttgcctcctggggtgcacaggcaggtggatggagaaggaagggctctggattggttagtgtgtatagcaaaggcttgcacgaacgctgagccctttgctacctctaagaattggctagcctgaggggcagcctctccccagccagaaagatctttaggatgtcaaaacatcataataattcttacaattccagcagtttgggaggcagaggagggtggatcacttgagcccaggagtccgagaccagcctggccaacatggtgaaaccctgtctctactgaaatacaaacattagccgggtatggtggtgcat

SEQ ID NO: 435203 - DNA, 3967 bp, Homo sapiens
cgtcattgtcccccgccgggcggctgggctgtgtgcggcggcggcggcggcggccgagggggatggagcgagcgccgagccgggtcagagttgaacaatgaccatagttgacaaagcttctgaatcttcagacccatcagcctatcagaatcagcctggcagctccgaggcagtctcacctggagacatggatgcaggttctgccagctggggtgctgtgtcttcattgaatgatgtgtcaaatcacacactttctttaggaccagtacctggtgctgtagtttattcgagttcatctgtacctgataaatcaaaaccatcaccacaaaaggatcaagccctaggtgatggcatcgctcctccacagaaagttcttttcccatctgagaagatttgtcttaagtggcaacaaactcatagagttggagctgggctccagaatttgggcaatacctgttttgccaatgcagcactgcagtgtttaacctacacaccacctcttgccaattacatgctatcacatgaacactccaaaacatgtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgcagaaagcatgcttgaatggcagcaataaattagacagacacacccaggccaccactcttgtttgtcagatatttggaggatacctaagatctagagtcaaatgtttaaattgcaagggcgtttcagatacttttgatccatatcttgatataacattggagataaaggctgctcagagtgtcaacaaggcattggagcagtttgtgaagccggaacagcttgatggagaaaactcgtacaagtgcagcaagtgtaaaaagatggttccagcttcaaagaggttcactatccatagatcctctaatgttcttacactttctctgaaacgttttgcaaattttaccggtggaaaaattgctaaggatgtgaaataccctgagtatcttgatattcggccatatatgtctcaacccaacggagagccaattgtctacgtcttgtatgcagtgctggtccacactggttttaattgccatgctggccattacttctgctacataaaagctagcaatggcctctggtatcaaatgaatgactccattgtatctaccagtgatattagatcggtactcagccaacaagcctatgtgctcttttatatcaggtcccatgatgtgaaaaatggaggtgaacttactcatcccacccatagccccggccagtcctctccccgccccgtcatcagtcagcgggttgtcaccaacaaacaggctgcgccaggctttatcggaccacagcttccctctcacatgataaagaatccacctcacttaaatgggactggaccattgaaagacacgccaagcagttccatgtcgagtcctaacgggaattccagtgtcaacagggctagtcctgttaatgcttcagcttctgtccaaaactggtcagttaataggtcctcagtgatcccagaacatcctaagaaacaaaaaattacaatcagtattcacaacaagttgcctgttcgccagtgtcagtctcaacctaaccttcatagtaattctttggagaaccctaccaagcccgttccctcttctaccattaccaattctgcagtacagtctacctcgaacgcatctacgatgtcagtttctagtaaagtaacaaaaccgatcccccgcagtgaatcctgctcccagcccgtgatgaatggcaaatccaagctgaactccagcgtgctggtgccctatggcgccgagtcctctgaggactctgacgaggagtcaaaggggctgggcaaggagaatgggattggtacgattgtgagctcccactctcccggccaagatgccgaagatgaggaggccactccgcacgagcttcaagaacccatgaccctaaacggtgctaatagtgcagacagcgacagtgacccgaaagaaaacggcctagcgcctgatggtgccagctgccaaggccagcctgccctgcactcagaaaatccctttgctaaggcaaacggtcttcctggaaagttgatgcctgctcctttgctgtctctcccagaagacaaaatcttagagaccttcaggcttagcaacaaactgaaaggctcgacggatgaaatgagtgcacctggagcagagaggggccctcccgaggaccgcgacgccgagcctcagcctggcagccccgccgccgaatccctggaggagccagatgcggccgccggcctcagcagcaccaagaaggctccgccgccccgcgatcccggcacccccgctaccaaagaaggcgcctgggaggccatggccgtcgcccccgaggagcctccgcccagcgccggcgaggacatcgtgggggacacagcaccccctgacctgtgtgatcccgggagcttaacaggcgatgcgagcccgttgtcccaggacgcaaaggggatgatcgcggagggcccgcgggactcggcgttggcggaagccccggaagggttgagtccggctccgcctgcgcggtcggaggagccctgcgagcagccactccttgttcaccccagcggggaccacgcccgggacgctcaggacccatcccagagcttgggcgcacccgaggccgcagagcggccgccagctcctgtgctggacatggccccggccggtcacccggaaggggacgctgagcctagccccggcgagagggtcgaggacgccgcggcgccgaaagccccaggcccttccccagcgaaggagaaaatcggcagcctcagaaaggtggaccgaggccactaccgcagccggagagagcgctcgtccagcggggagcccgccagagagagcaggagcaagactgagggccaccgtcaccggcggcgccgcacctgcccccgggagcgcgaccgccaggaccgccacgccccggagcaccaccccggccacggcgacaggctcagccctggcgagcgccgctctctgggcaggtgcagtcaccaccactcccgacaccggagcggggtggagctggactgggtcagacaccactacaccgagggcgagcgtggctggggccgggagaagttctaccccgacaggccgcgctgggacaggtgccggtactaccatgacaggtacgccctgtacgctgcccgggactggaagcccttccacggcggccgcgagcacgagcgggccgggctgcacgagcggccgcacaaggaccacaaccggggccgtaggggctgcgagccggcccgggagagggagcggcaccgccccagcagcccccgcgcaggcgcgccccacgccctcgccccgcaccccgaccgcttctcccacgacagaactgcacttgtagccggagacaactgtaacctctctgatcggtttcacgaacacgaaaatggaaagtcccggaaacggagacacgacagtgtggagaacagtgacagtcatgttgaaaagaaagcccggaggagcgaacagaaggatcctctagaagagcctaaagcaaagaagcacaaaaaatcaaagaagaaaaagaaatccaaagacaaacaccgagaccgcgactccaggcatcagcaggactcagacctctcagcagcgtgctctgacgctgacctccaccctcgtgccgaattcgcggtagtgttacccttctgatgttggaacaagggtgggaccagacactattgctaggtttcttggtgccatctgatctgtgtctgaattttctgccactgtgttcagatgagctgaaaggaacttaagtgtttcagagtgatgttcaggcaaatcgtgaat

SEQ ID NO: 435204 - DNA, 4531 bp, Homo sapiens
agatggagtagaagcccacattccccactcagcctccgttggcaccccaggtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgcagaaagcatgcttgaatggcagcaataaattagacagacacacccaggccaccactcttgtttgtcagatatttggaggatacctaagatctagagtcaaatgtttaaattgcaagggcgtttcagatacttttgatccatatcttgatataacattggagataaaggtgtaaaaagatggttccagcttcaaagaggttcactatccatagatcctctaatgttcttacactttctctgaaacgttttgcaaattttaccggtggaaaaattgctaaggatgtgaaataccctgagtatcttgatattcggccatatatgtctcaacccaacggagagccaattgtctacgtcttgtatgcagtgctggtccacactggttttaattgccatgctggccattacttctgctacataaaagctagcaatggcctctggtatcaaatgaatgactccattgtatctaccagtgatattagatcggtactcagccaacaagcctatgtgctcttttatatcaggtcccatgatgtgaaaaatggaggtgaacttactcatcccacccatagccccggccagtcctctccccgccccgtcatcagtcagcgggttgtcaccaacaaacaggctgcgccaggctttatcggaccacagcttccctctcacatgataaagaatccacctcacttaaatgggactggaccattgaaagacacgccaagcagttccatgtcgagtcctaacgggaattccagtgtcaacagggctagtcctgttaatgcttcagcttctgtccaaaactggtcagttaataggtcctcagtgatcccagaacatcctaagaaacaaaaaattacaatcagtattcacaacaagttgcctgttcgccagtgtcagtctcaacctaaccttcatagtaattctttggagaaccctaccaagcccgttccctcttctaccattaccaattctgcagtacagtctacctcgaacgcatctacgatgtcagtttctagtaaagtaacaaaaccgatcccccgcagtgaatcctgctcccagcccgtgatgaatggcaaatccaagctgaactccagcgtgctggtgccctatggcgccgagtcctctgaggactctgacgaggagtcaaaggggctgggcaaggagaatgggattggtacgattgtgagctcccactctcccggccaagatgccgaagatgaggaggccactccgcacgagcttcaagaacccatgaccctaaacggtgctaatagtgcagacagcgacagtgacccgaaagaaaacggcctagcgcctgatggtgccagctgccaaggccagcctgccctgcactcagaaaatccctttgctaaggcaaacggtcttcctggaaagttgatgcctgctcctttgctgtctctcccagaagacaaaatcttagagaccttcaggcttagcaacaaactgaaaggctcgacggatgaaatgagtgcacctggagcagagaggggccctcccgaggaccgcgacgccgagcctcagcctggcagccccgccgccgaatccctggaggagccagatgcggccgccggcctcagcagcaccaagaaggctccgccgccccgcgatcccggcacccccgctaccaaagaaggcgcctgggaggccatggccgtcgcccccgaggagcctccgcccagcgccggcgaggacatcgtgggggacacagcaccccctgacctgtgtgatcccgggagcttaacaggcgatgcgagcccgttgtcccaggacgcaaaggggatgatcgcggagggcccgcgggactcggcgttggcggaagccccggaagggttgagtccggctccgcctgcgcggtcggaggagccctgcgagcagccactccttgttcaccccagcggggaccacgcccgggacgctcaggacccatcccagagcttgggcgcacccgaggccgcagagcggccgccagctcctgtgctggacatggccccggccggtcacccggaaggggacgctgagcctagccccggcgagagggtcgaggacgccgcggcgccgaaagccccaggcccttccccagcgaaggagaaaatcggcagcctcagaaaggtggaccgaggccactaccgcagccggagagagcgctcgtccagcggggagcccgccagagagagcaggagcaagactgagggccaccgtcaccggcggcgccgcacctgcccccgggagcgcgaccgccaggaccgccacgccccggagcaccaccccggccacggcgacaggctcagccctggcgagcgccgctctctgggcaggtgcagtcaccaccactcccgacaccggagcggggtggagctggactgggtcagacaccactacaccgagggcgagcgtggctggggccgggagaagttctaccccgacaggccgcgctgggacaggtgccggtactaccatgacaggtacgccctgtacgctgcccgggactggaagcccttccacggcggccgcgagcacgagcgggccgggctgcacgagcggccgcacaaggaccacaaccggggccgtaggggctgcgagccggcccgggagagggagcggcaccgccccagcagcccccgcgcaggcgcgccccacgccctcgccccgcaccccgaccgcttctcccacgacagaactgcacttgtagccggagacaactgtaacctctctgatcggtttcacgaacacgaaaatggaaagtcccggaaacggagacacgacagtgtggagaacagtgacagtcatgttgaaaagaaagcccggaggagcgaacagaaggatcctctagaagagcctaaagcaaagaagcacaaaaaatcaaagaagaaaaagaaatccaaagacaaacaccgagaccgcgactccaggcatcagcaggactcagacctctcagcagcgtgctctgacgctgacctccacagacacaaaaaaaagaagaagaaaaagaagagacattcaagaaaatcagaggactttgttaaagattcagaactgcacttacccagggtcaccagcttggagactgtcgcccagttccggagagcccagggtggctttcctctctctggtggcccgcctctggaaggcgtcggacctttccgtgagaaaacgaaacacttacggatggaaagcagggatgacaggtgtcgtctctttgagtatggccagggtgattgaaaactcagcctcaaaacaaaaaattcactagttatgattcaacgcgttcaacagaagccatccccagcccagcttaaattataaagatagacaataactctgttccaatctgcgtggtgcttctttagtaaatactgtacagattttaccatggagaactttttttttagtttttaccttttcttaattacccttattccgaatggacgaacactttctaccactgctgaccattgtaaaataccgtgtatataaatcccattgaaataatgccctggaatagaacatctcaaatgctgcttaattacagactcaggtcgattacttgtatttcatgtaatgttcctccaagttagacatctggtgcaagaccaaccgggagaccatggaattgtcaaaagtacaaactgacagtgtgtatatttaatttaaagacttatttaaaaactcacaagctctcacctagactttggagagcagtctgttttctgtaatgtctgatactagaaactaatttgcttattttagttgtattcaagatttgaagatgtattttatagacaagttctgtttttgaactttgtggaactgttccaatcaatcaatttcccagttatgatgagtatttacattatgaatgtataacccagacatgatttgtaaagccgacagtatgtttctattacacaacactttttgatacagcgtctcttgtcttcactgatactggagtctccgttgtctgcttggtcccttcgagtttctagttacagacacaatcatactgtgattttatttttaatatggatatgctatcaaactgtgatacacttataattcactggtcctgcatcaggagatggagtggggaaaactgtatttaatacagtttgtatctgaataatctgtatggtttatacagtttgtgttgttcagagatgtttaaagtttgatctttgtttttctaaagattaaaaaagcacttgccccactgtaaatatacagcatgtaaaatttctatagtatataaatggcagcaaatcccaaaaaaaaaa

SEQ ID NO: 435205 - DNA, 1863 bp, Homo sapiens
tgcattactggctggggaagacccgcatccttcacgcaggcagagtcgccctgttcccttgtgcctcacttgggaaaagccaacccggctcacagcggcagagcccacgggcctttgataaacatctgggaagggagaggcccggtccccagcacaggcacctcactcaggagagcggagccttgctccctcgtccgtcccgtcccctgtgctgctgtctgcgccccgaggtggcactgagctggagccagcacccccccagcagccaccgtacaaaaccataggaaggtggcccagggccgggcagcagatcaggacctcggagctgtggggctttgttggatcacttcacacagcggtcctgggagagtcactggttttatacctgacccttgtggagctagaggggacagtgaaccatttttcccttgaaaggaaactttgtccaaatgtgtctgtcacatgtagtcagcaagaggaatttaaaatgaattgccaagtgaagagtctgtggattaattggccgttaattaacaggctttatcaatgtgtcctcaagggagaggcccaaccctaattaaggagctaaacttcctgagtgaggggctgtgaggatggaggtggaggaggcatctggggcgggtggtggccgggcccagcagatggcgcctccctggctgagctgcccgcaccgccagttccctcatttccactcaggaaggcagagtgatctcaaggaagagcttccccagccttcgggagcagctggcagggcgtccgggaataagccctacacgccgccgcctgcctccaactcactaaccctgcgcctcttgtctttcagattcaacgcgttcaacagaagccatccccagcccagcttaaattataaagatagacaataactctgttccaatctgcgtggtgcttctttagtaaatactgtacagattttaccatggagaactttttttttagtttttaccttttcttaattacccttattccgaatggacgaacactttctaccactgctgaccattgtaaaataccgtgtatataaatcccattgaaataatgccctggaatagaacatctcaaatgctgcttaattacagactcaggtcgattacttgtatttcatgtaatgttcctccaagttagacatctggtgcaagaccaaccgggagaccatggaattgtcaaaagtacaaactgacagtgtgtatatttaatttaaagacttatttaaaaactcacaagctctcacctagactttggagagcagtctgttttctgtaatgtctgatactagaaactaatttgcttattttagttgtattcaagatttgaagatgtattttatagacaagttctgtttttgaactttgtggaactgttccaatcaatcaatttcccagttatgatgagtatttacattatgaatgtataacccagacatgatttgtaaagccgacagtatgtttctattacacaacactttttgatacagcgtctcttgtcttcactgatactggagtctccgttgtctgcttggtcccttcgagtttctagttacagacacaatcatactgtgattttatttttaatatggatatgctatcaaactgtgatacacttataattcactggtcctgcatcaggagatggagtggggaaaactgtatttaatacagtttgtatctgaataatctgtatggtttatacagtttgtgttgttcagagatgtttaaagtttgatctttgtttttctaaagattaaaaaagcacttgccccactgtaaatatacagcatgtaaaatttctatagtatataaatggcagcaaatcccaaaaaaaaaa

SEQ ID NO: 435206 - DNA, 805 bp, Homo sapiens
cgtcattgtcccccgccgggcggctgggctgtgtgcggcggcggcggcggcggccgagggggatggagcgagcgccgagccgggtcagagttgaacaatgaccatagttgacaaagcttctgaatcttcagacccatcagcctatcagaatcagcctggcagctccgaggcagtctcacctggagacatggatgcaggttctgccagctggggtgctgtgtcttcattgaatgatgtgtcaaatcacacactttctttaggaccagtacctggtgctgtagtttattcgagttcatctgtacctgataaatcaaaaccatcaccacaaaaggatcaagccctaggtgatggcatcgctcctccacagaaagttcttttcccatctgagaagatttgtcttaagtggcaacaaactcatagagttggagctgggctccagaatttgggcaatacctgttttgccaatgcagcactgcagtgtttaacctacacaccacctcttgccaattacatgctatcacatgaacactccaaaacatgtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgcagaaagcatgcttgaatggcagcaataaattagactagacacacccaaacctgtatgacccgaatggatcctcgggtcag

SEQ ID NO: 435207 - DNA, 385 bp, Homo sapiens
tctgcagtccagcctgggcgacgcagcaagaccctgtctcaaaaaaaggaaaatataaataaacagaaaagaaatacctttcagatgaaacagcatcttcagaaaacacagtttaaagaacgtcatttacccagttatccttgttgtctcctgatctgagtgcctgacattagcctgaaggaggggatgtgtatagctccatactgtgtagcataaacatgctatttttttcatcaggtttccgcctgaggggttaaatgctgttgactttgtaaatgaatctctcctaaggaggtgtcctgtgtcaccctaagtatcgctctccttgtttccaggtcccatgatgtgaaaaatggaggtgaacttactcatcccacccatagcc

SEQ ID NO: 435208 - DNA, 383 bp, Homo sapiens
ttgtttactggagaaaccagatcattgaaaatttctcatgttctggtttctgtcttttaaaatgtccctcttccccctgtatttcaggtaggctggtcatgagatttcggatcttgtaaagattgaggtttgaccaggtgttactatttatttagcttcagtatgcaaagcttggtttctgactctttcttgtttatttttctagccctaggtgatggcatcgctcctccacagaaagttcttttcccatctgagaagatttgtcttaagtggcaacaaactcatagagttggagctgggctccagaatttgggcaatacctgttttgccaatgcagcactgcagtgtttaacctacacaccacctcttgccaattacatgct

SEQ ID NO: 435209 - DNA, 290 bp, Homo sapiens
ggtgttctgtgggtctcccctcctaggaagctctaagtaccctctacctgaatatgtggaatgatctgtgccctcggaaatgtttctcctgtttccatttccttctaggatgtgaaataccctgagtatcttgatattcggccatatatgtctcaacccaacggagagccaattgtctacgtcttgtatgcagtgctggtccacactggttttaattgccatgctggccattacttctgctacataaaagtaagctgtgcagatttgctattaactattgttacatacat

SEQ ID NO: 435210 - DNA, 5103 bp, Homo sapiens
cgtcattgtcccccgccgggcggctgggctgtgtgcggcggcggcggcggcggccgagggggatggagcgagcgccgagccgggtcagagttgaacaatgaccatagttgacaaagcttctgaatcttcagacccatcagcctatcagaatcagcctggcagctccgaggcagtctcacctggagacatggatgcaggttctgccagctggggtgctgtgtcttcattgaatgatgtgtcaaatcacacactttctttaggaccagtacctggtgctgtagtttattcgagttcatctgtacctgataaatcaaaaccatcaccacaaaaggatcaagccctaggtgatggcatcgctcctccacagaaagttcttttcccatctgagaagatttgtcttaagtggcaacaaactcatagagttggagctgggctccagaatttgggcaatacctgttttgccaatgcagcactgcagtgtttaacctacacaccacctcttgccaattacatgctatcacatgaacactccaaaacatgtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgcagaaagcatgcttgaatggcagcaataaattagacagacacacccaggccaccactcttgtttgtcagatatttggaggatacctaagatctagagtcaaatgtttaaattgcaagggcgtttcagatacttttgatccatatcttgatataacattggagataaaggctgctcagagtgtcaacaaggcattggagcagtttgtgaagccggaacagcttgatggagaaaactcgtacaagtgcagcaagtgtaaaaagatggttccagcttcaaagaggttcactatccatagatcctctaatgttcttacactttctctgaaacgttttgcaaattttaccggtggaaaaattgctaaggatgtgaaataccctgagtatcttgatattcggccatatatgtctcaacccaacggagagccaattgtctacgtcttgtatgcagtgctggtccacactggttttaattgccatgctggccattacttctgctacataaaagctagcaatggcctctggtatcaaatgaatgactccattgtatctaccagtgatattagatcggtactcagccaacaagcctatgtgctcttttatatcaggtcccatgatgtgaaaaatggaggtgaacttactcatcccacccatagccccggccagtcctctccccgccccgtcatcagtcagcgggttgtcaccaacaaacaggctgcgccaggctttatcggaccacagcttccctctcacatgataaagaatccacctcacttaaatgggactggaccattgaaagacacgccaagcagttccatgtcgagtcctaacgggaattccagtgtcaacagggctagtcctgttaatgcttcagcttctgtccaaaactggtcagttaataggtcctcagtgatcccagaacatcctaagaaacaaaaaattacaatcagtattcacaacaagttgcctgttcgccagtgtcagtctcaacctaaccttcatagtaattctttggagaaccctaccaagcccgttccctcttctaccattaccaattctgcagtacagtctacctcgaacgcatctacgatgtcagtttctagtaaagtaacaaaaccgatcccccgcagtgaatcctgctcccagcccgtgatgaatggcaaatccaagctgaactccagcgtgctggtgccctatggcgccgagtcctctgaggactctgacgaggagtcaaaggggctgggcaaggagaatgggattggtacgattgtgagctcccactctcccggccaagatgccgaagatgaggaggccactccgcacgagcttcaagaacccatgaccctaaacggtgctaatagtgcagacagcgacagtgacccgaaagaaaacggcctagcgcctgatggtgccagctgccaaggccagcctgccctgcactcagaaaatccctttgctaaggcaaacggtcttcctggaaagttgatgcctgctcctttgctgtctctcccagaagacaaaatcttagagaccttcaggcttagcaacaaactgaaaggctcgacggatgaaatgagtgcacctggagcagagaggggccctcccgaggaccgcgacgccgagcctcagcctggcagccccgccgccgaatccctggaggagccagatgcggccgccggcctcagcagcaccaagaaggctccgccgccccgcgatcccggcacccccgctaccaaagaaggcgcctgggaggccatggccgtcgcccccgaggagcctccgcccagcgccggcgaggacatcgtgggggacacagcaccccctgacctgtgtgatcccgggagcttaacaggcgatgcgagcccgttgtcccaggacgcaaaggggatgatcgcggagggcccgcgggactcggcgttggcggaagccccggaagggttgagtccggctccgcctgcgcggtcggaggagccctgcgagcagccactccttgttcaccccagcggggaccacgcccgggacgctcaggacccatcccagagcttgggcgcacccgaggccgcagagcggccgccagctcctgtgctggacatggccccggccggtcacccggaaggggacgctgagcctagccccggcgagagggtcgaggacgccgcggcgccgaaagccccaggcccttccccagcgaaggagaaaatcggcagcctcagaaaggtggaccgaggccactaccgcagccggagagagcgctcgtccagcggggagcccgccagagagagcaggagcaagactgagggccaccgtcaccggcggcgccgcacctgcccccgggagcgcgaccgccaggaccgccacgccccggagcaccaccccggccacggcgacaggctcagccctggcgagcgccgctctctgggcaggtgcagtcaccaccactcccgacaccggagcggggtggagctggactgggtcagacaccactacaccgagggcgagcgtggctggggccgggagaagttctaccccgacaggccgcgctgggacaggtgccggtactaccatgacaggtacgccctgtacgctgcccgggactggaagcccttccacggcggccgcgagcacgagcgggccgggctgcacgagcggccgcacaaggaccacaaccggggccgtaggggctgcgagccggcccgggagagggagcggcaccgccccagcagcccccgcgcaggcgcgccccacgccctcgccccgcaccccgaccgcttctcccacgacagaactgcacttgtagccggagacaactgtaacctctctgatcggtttcacgaacacgaaaatggaaagtcccggaaacggagacacgacagtgtggagaacagtgacagtcatgttgaaaagaaagcccggaggagcgaacagaaggatcctctagaagagcctaaagcaaagaagcacaaaaaatcaaagaagaaaaagaaatccaaagacaaacaccgagaccgcgactccaggcatcagcaggactcagacctctcagcagcgtgctctgacgctgacctccacagacacaaaaaaaagaagaagaaaaagaagagacattcaagaaaatcagaggactttgttaaagattcagaactgcacttacccagggtcaccagcttggagactgtcgcccagttccggagagcccagggtggctttcctctctctggtggcccgcctctggaaggcgtcggacctttccgtgagaaaacgaaacacttacggatggaaagcagggatgacaggtgtcgtctctttgagtatggccagggtgattgaaaactcagcctcaaaacaaaaaattcactagttatgattcaacgcgttcaacagaagccatccccagcccagcttaaattataaagatagacaataactctgttccaatctgcgtggtgcttctttagtaaatactgtacagattttaccatggagaactttttttttagtttttaccttttcttaattacccttattccgaatggacgaacactttctaccactgctgaccattgtaaaataccgtgtatataaatcccattgaaataatgccctggaatagaacatctcaaatgctgcttaattacagactcaggtcgattacttgtatttcatgtaatgttcctccaagttagacatctggtgcaagaccaaccgggagaccatggaattgtcaaaagtacaaactgacagtgtgtatatttaatttaaagacttatttaaaaactcacaagctctcacctagactttggagagcagtctgttttctgtaatgtctgatactagaaactaatttgcttattttagttgtattcaagatttgaagatgtattttatagacaagttctgtttttgaactttgtggaactgttccaatcaatcaatttcccagttatgatgagtatttacattatgaatgtataacccagacatgatttgtaaagccgacagtatgtttctattacacaacactttttgatacagcgtctcttgtcttcactgatactggagtctccgttgtctgcttggtcccttcgagtttctagttacagacacaatcatactgtgattttatttttaatatggatatgctatcaaactgtgatacacttataattcactggtcctgcatcaggagatggagtggggaaaactgtatttaatacagtttgtatctgaataatctgtatggtttatacagtttgtgttgttcagagatgtttaaagtttgatctttgtttttctaaagattaaaaaagcacttgccccactgtaaatatacagcatgtaaaatttctatagtatataaatggcagcaaatcccaaaaaaaaaa

SEQ ID NO: 435211 - DNA, 4685 bp, Homo sapiens
aaagattttatgctcacagggcacaccatgcagggccatgtggtgaggaagcagaagacaggagcaaggggaaggcattattggccagagccttcgttgaggtttccgtgggaaaagcagggtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgcagaaagcatgcttgaatggcagcaataaattagacagacacacccaggccaccactcttgtttgtcagatatttggaggatacctaagatctagagtcaaatgtttaaattgcaagggcgtttcagatacttttgatccatatcttgatataacattggagataaaggctgctcagagtgtcaacaaggcattggagcagtttgtgaagccggaacagcttgatggagaaaactcgtacaagtgcagcaagtgtaaaaagatggttccagcttcaaagaggttcactatccatagatcctctaatgttcttacactttctctgaaacgttttgcaaattttaccggtggaaaaattgctaaggatgtgaaataccctgagtatcttgatattcggccatatatgtctcaacccaacggagagccaattgtctacgtcttgtatgcagtgctggtccacactggttttaattgccatgctggccattacttctgctacataaaagctagcaatggcctctggtatcaaatgaatgactccattgtatctaccagtgatattagatcggtactcagccaacaagcctatgtgctcttttatatcaggtcccatgatgtgaaaaatggaggtgaacttactcatcccacccatagccccggccagtcctctccccgccccgtcatcagtcagcgggttgtcaccaacaaacaggctgcgccaggctttatcggaccacagcttccctctcacatgataaagaatccacctcacttaaatgggactggaccattgaaagacacgccaagcagttccatgtcgagtcctaacgggaattccagtgtcaacagggctagtcctgttaatgcttcagcttctgtccaaaactggtcagttaataggtcctcagtgatcccagaacatcctaagaaacaaaaaattacaatcagtattcacaacaagttgcctgttcgccagtgtcagtctcaacctaaccttcatagtaattctttggagaaccctaccaagcccgttccctcttctaccattaccaattctgcagtacagtctacctcgaacgcatctacgatgtcagtttctagtaaagtaacaaaaccgatcccccgcagtgaatcctgctcccagcccgtgatgaatggcaaatccaagctgaactccagcgtgctggtgccctatggcgccgagtcctctgaggactctgacgaggagtcaaaggggctgggcaaggagaatgggattggtacgattgtgagctcccactctcccggccaagatgccgaagatgaggaggccactccgcacgagcttcaagaacccatgaccctaaacggtgctaatagtgcagacagcgacagtgacccgaaagaaaacggcctagcgcctgatggtgccagctgccaaggccagcctgccctgcactcagaaaatccctttgctaaggcaaacggtcttcctggaaagttgatgcctgctcctttgctgtctctcccagaagacaaaatcttagagaccttcaggcttagcaacaaactgaaaggctcgacggatgaaatgagtgcacctggagcagagaggggccctcccgaggaccgcgacgccgagcctcagcctggcagccccgccgccgaatccctggaggagccagatgcggccgccggcctcagcagcaccaagaaggctccgccgccccgcgatcccggcacccccgctaccaaagaaggcgcctgggaggccatggccgtcgcccccgaggagcctccgcccagcgccggcgaggacatcgtgggggacacagcaccccctgacctgtgtgatcccgggagcttaacaggcgatgcgagcccgttgtcccaggacgcaaaggggatgatcgcggagggcccgcgggactcggcgttggcggaagccccggaagggttgagtccggctccgcctgcgcggtcggaggagccctgcgagcagccactccttgttcaccccagcggggaccacgcccgggacgctcaggacccatcccagagcttgggcgcacccgaggccgcagagcggccgccagctcctgtgctggacatggccccggccggtcacccggaaggggacgctgagcctagccccggcgagagggtcgaggacgccgcggcgccgaaagccccaggcccttccccagcgaaggagaaaatcggcagcctcagaaaggtggaccgaggccactaccgcagccggagagagcgctcgtccagcggggagcccgccagagagagcaggagcaagactgagggccaccgtcaccggcggcgccgcacctgcccccgggagcgcgaccgccaggaccgccacgccccggagcaccaccccggccacggcgacaggctcagccctggcgagcgccgctctctgggcaggtgcagtcaccaccactcccgacaccggagcggggtggagctggactgggtcagacaccactacaccgagggcgagcgtggctggggccgggagaagttctaccccgacaggccgcgctgggacaggtgccggtactaccatgacaggtacgccctgtacgctgcccgggactggaagcccttccacggcggccgcgagcacgagcgggccgggctgcacgagcggccgcacaaggaccacaaccggggccgtaggggctgcgagccggcccgggagagggagcggcaccgccccagcagcccccgcgcaggcgcgccccacgccctcgccccgcaccccgaccgcttctcccacgacagaactgcacttgtagccggagacaactgtaacctctctgatcggtttcacgaacacgaaaatggaaagtcccggaaacggagacacgacagtgtggagaacagtgacagtcatgttgaaaagaaagcccggaggagcgaacagaaggatcctctagaagagcctaaagcaaagaagcacaaaaaatcaaagaagaaaaagaaatccaaagacaaacaccgagaccgcgactccaggcatcagcaggactcagacctctcagcagcgtgctctgacgctgacctccacagacacaaaaaaaagaagaagaaaaagaagagacattcaagaaaatcagaggactttgttaaagattcagaactgcacttacccagggtcaccagcttggagactgtcgcccagttccggagagcccagggtggctttcctctctctggtggcccgcctctggaaggcgtcggacctttccgtgagaaaacgaaacacttacggatggaaagcagggatgacaggtgtcgtctctttgagtatggccagggtgattgaaaactcagcctcaaaacaaaaaattcactagttatgattcaacgcgttcaacagaagccatccccagcccagcttaaattataaagatagacaataactctgttccaatctgcgtggtgcttctttagtaaatactgtacagattttaccatggagaactttttttttagtttttaccttttcttaattacccttattccgaatggacgaacactttctaccactgctgaccattgtaaaataccgtgtatataaatcccattgaaataatgccctggaatagaacatctcaaatgctgcttaattacagactcaggtcgattacttgtatttcatgtaatgttcctccaagttagacatctggtgcaagaccaaccgggagaccatggaattgtcaaaagtacaaactgacagtgtgtatatttaatttaaagacttatttaaaaactcacaagctctcacctagactttggagagcagtctgttttctgtaatgtctgatactagaaactaatttgcttattttagttgtattcaagatttgaagatgtattttatagacaagttctgtttttgaactttgtggaactgttccaatcaatcaatttcccagttatgatgagtatttacattatgaatgtataacccagacatgatttgtaaagccgacagtatgtttctattacacaacactttttgatacagcgtctcttgtcttcactgatactggagtctccgttgtctgcttggtcccttcgagtttctagttacagacacaatcatactgtgattttatttttaatatggatatgctatcaaactgtgatacacttataattcactggtcctgcatcaggagatggagtggggaaaactgtatttaatacagtttgtatctgaataatctgtatggtttatacagtttgtgttgttcagagatgtttaaagtttgatctttgtttttctaaagattaaaaaagcacttgccccactgtaaatatacagcatgtaaaatttctatagtatataaatggcagcaaatcccaaaaaaaaaa

SEQ ID NO: 435212 - DNA, 3076 bp, Homo sapiens
cgtcattgtcccccgccgggcggctgggctgtgtgcggcggcggcggcggcggccgagggggatggagcgagcgccgagccgggtcagagttgaacaatgaccatagttgacaaagcttctgaatcttcagacccatcagcctatcagaatcagcctggcagctccgaggcagtctcacctggagacatggatgcaggttctgccagctggggtgctgtgtcttcattgaatgatgtgtcaaatcacacactttctttaggaccagtacctggtgctgtagtttattcgagttcatctgtacctgataaatcaaaaccatcaccacaaaaggatcaagccctaggtgatggcatcgctcctccacagaaagttcttttcccatctgagaagatttgtcttaagtggcaacaaactcatagagttggagctgggctccagaatttgggcaatacctgttttgccaatgcagcactgcagtgtttaacctacacaccacctcttgccaattacatgctatcacatgaacactccaaaacatgtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgcagaaagcatgcttgaatggcagcaataaattagacagacacacccaggccaccactcttgtttgtcagatatttggaggatacctaagatctagagtcaaatgtttaaattgcaagggcgtttcagatacttttgatccatatcttgatataacattggagataaaggctgctcagagtgtcaacaaggcattggagcagtttgtgaagccggaacagcttgatggagaaaactcgtacaagtgcagcaagtgtaaaaagatggttccagcttcaaagaggttcactatccatagatcctctaatgttcttacactttctctgaaacgttttgcaaattttaccggtggaaaaattgctaaggatgtgaaataccctgagtatcttgatattcggccatatatgtctcaacccaacggagagccaattgtctacgtcttgtatgcagtgctggtccacactggttttaattgccatgctggccattacttctgctacataaaagctagcaatggcctctggtatcaaatgaatgactccattgtatctaccagtgatattagatcggtactcagccaacaagcctatgtgctcttttatatcaggtcccatgatgtgaaaaatggaggtgaacttactcatcccacccatagccccggccagtcctctccccgccccgtcatcagtcagcgggttgtcaccaacaaacaggctgcgccaggctttatcggaccacagcttccctctcacatgataaagaatccacctcacttaaatgggactggaccattgaaagacacgccaagcagttccatgtcgagtcctaacgggaattccagtgtcaacagggctagtcctgttaatgcttcagcttctgtccaaaactggtcagttaataggtcctcagtgatcccagaacatcctaagaaacaaaaaatcaaagaagaaaaagaaatccaaagacaaacaccgagaccgcgactccaggcatcagcaggactcagacctctcagcagcgtgctctgacgctgacctccacagacacaaaaaaaagaagaagaaaaagaagagacattcaagaaaatcagaggactttgttaaagattcagaactgcacttacccagggtcaccagcttggagactgtcgcccagttccggagagcccagggtggctttcctctctctggtggcccgcctctggaaggcgtcggacctttccgtgagaaaacgaaacacttacggatggaaagcagggatgacaggtgtcgtctctttgagtatggccagggtgattgaaaactcagcctcaaaacaaaaaattcactagttatgattcaacgcgttcaacagaagccatccccagcccagcttaaattataaagatagacaataactctgttccaatctgcgtggtgcttctttagtaaatactgtacagattttaccatggagaactttttttttagtttttaccttttcttaattacccttattccgaatggacgaacactttctaccactgctgaccattgtaaaataccgtgtatataaatcccattgaaataatgccctggaatagaacatctcaaatgctgcttaattacagactcaggtcgattacttgtatttcatgtaatgttcctccaagttagacatctggtgcaagaccaaccgggagaccatggaattgtcaaaagtacaaactgacagtgtgtatatttaatttaaagacttatttaaaaactcacaagctctcacctagactttggagagcagtctgttttctgtaatgtctgatactagaaactaatttgcttattttagttgtattcaagatttgaagatgtattttatagacaagttctgtttttgaactttgtggaactgttccaatcaatcaatttcccagttatgatgagtatttacattatgaatgtataacccagacatgatttgtaaagccgacagtatgtttctattacacaacactttttgatacagcgtctcttgtcttcactgatactggagtctccgttgtctgcttggtcccttcgagtttctagttacagacacaatcatactgtgattttatttttaatatggatatgctatcaaactgtgatacacttataattcactggtcctgcatcaggagatggagtggggaaaactgtatttaatacagtttgtatctgaataatctgtatggtttatacagtttgtgttgttcagagatgtttaaagtttgatctttgtttttctaaagattaaaaaagcacttgccccactgtaaatatacagcatgtaaaatttctatagtatataaatggcagcaaatcccaaaaaaaaaa

SEQ ID NO: 435213 - DNA, 832 bp, Homo sapiens
ctgcccggtgagagctgccgtggattggtgggggcactgactcactggccctgccatgcccacgccactgctcccgctgctgcttcgattgctgctgtcctgcctgctgctgcctgctgcccgcctggcccgccaatacctcctgcccctgctgcgccgattggcccgccgcctgggctcccaggacatgcgagaggctttgctgggctgtctgctgttcattctcagccagcgacactcgccagacgctggggaggcctcaagagtggaccgcctggagaggagggagaggttaggcccccaaaagtgaggccacaagtcctggcagcagctgtatccacaaaatgctttcttttggagtaggataagactggcaccagcactgaccgaagcctgcccagtggacagaagatatagtgagggttgtgcatgagagggatctgccacagacatgcctctccactcccaacagaaatgtctttctggaagaatgccttgcatctagcacaaaactgattattgcccctctgtcctccagcagttcctcccaaagaccactcctaatcacctctggcctcaggcgggaggggaactaacacccacccacccctgccctccctgcaaatgggaacatcaaggttcccagtgcttaactgagggacaagtgacaatttagcagagaggcaagatttgaatccagactgtcttccagactcaggacctaccttaaaataatatctgagttgcttatggaggcagacctgcctgcaaagcccagcactcagcaagtgctcaataaatatttgatttgaattctttcaaaaaaatgaaa

SEQ ID NO: 435214 - DNA, 7658 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatg

SEQ ID NO: 435215 - DNA, 1279 bp, Homo sapiens
  misc_feature (13)..(13): n is a, c, g, or t
  misc_feature (46)..(46): n is a, c, g, or t
ggccccaaagganttttaggaatgggccccccaggtccatgttagnctggagaagtggcagaagcccaagttgtgaatcccgcacctggctctggagccctgttctcagccaccgtgctgggcagcccacacctggcatcctctctgttaggagcaggggcctgcccccacgccctctctgacattgctattcttgctaaaatgaagagacagagctgaggggagagctaaaaattatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaacgtggaatctgttttctcaccttctgttctcgatttcccatctgtgatctgactggagggtgggtgctacacaccaacttcaaatgatggcgccaggccctttttgctgagggcgctgtctcccaggtcagacgacagaataattctcaggccagtcctggctccaactcttgttcctgccagtgcctcacaggatgcacacgcactaggaagggaaagaccacccaaaggcaggagctggcccacctgtcaagggagtgatttaggagggctctggtcaccagccaatgaagctcactgctgggttaggacattttcaggggtccagtacatttcaggctgcattttcaggcagacacgcattgaagatgcttttggaggattcagtgatgaggccaagggcagcctctctagtgcgggccaactaggatgagagaaatactagggcagcacagaatcaaacagagaatgccgatttcttgttccataatattctccggttagactggttctgggggtaaggggtctatgactaggcttcttggcagcagtggaaacgtgtgaaatgggccgaagtgccctcttcctcctgtgccactaccataggagaggaaaggtgagtcacaggtatggtgcttcagcagggctcccacccccacatccagtatcttatccaagagtgtacagaattcagaggcttgtttttctcaaaaagtaagaactctgggctgggcatggtgctcacgcctgtaatcccggcactttgggaggccaaagcaggtggatcatttgaggtcagaagttcgaatccagcctggccaacatggtgaaacaccgtctctactaa

SEQ ID NO: 435216 - DNA, 931 bp, Homo sapiens
ccataccgctacgtacgagacccccgctttaacttcgcgcacgagggtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccagtgaaggttatcggatcatcccgggcggcacctacaaccagggccagaacggttttgatctggtgttccaggggccgagcaatgcggtgtatctgctggaggtcaagcacgtctcaacagccagcggtggccgtttttccaatgtgaacatggcgcgggtgatcccgcgaagaagaaaatgatccgggtcgagctcata

SEQ ID NO: 435217 - DNA, 490 bp, Homo sapiens
gttgccctttacgacaaaaaaaacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccaggtgggtcggccacgtgtcgtttcctcctggcagagctcttgcttttgttcgtttggttta

SEQ ID NO: 435218 - DNA, 7577 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatag

SEQ ID NO: 435219 - DNA, 7606 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctcaggaatcgcctaaaccagtgaacaccagggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatag

SEQ ID NO: 435220 - DNA, 7540 bp, Homo sapiens
ctgagggcaaacccatcagacaaccagagccataatttgtggtcaccgctgaaatttaccttggaaactcgaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatag

SEQ ID NO: 435221 - DNA, 6853 bp, Homo sapiens
caggaatcgcctaaaccagtgaaacaccagagtggatccctgttgtatggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatag

SEQ ID NO: 435222 - DNA, 6983 bp, Homo sapiens
aaacttctgaatgactgggatctcactactttcttttattaataatttctaattttattatgttatagtccaggaaaatagcctattctgttgctacttttttgaaatgtatcacagcctgttttcttcttttttctttttgtttgaggcaatatataagatccattattgtaactaattcatggatacttgttgtcttcttagtttattagtgttcatatccagtatgtacttacttattttcaattttctctttttaatttattttcagggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatag

SEQ ID NO: 435223 - DNA, 5305 bp, Homo sapiens
aggccggcgcttaatcggccgagggtttccacggaatcatgacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatag

SEQ ID NO: 435224 - DNA, 6719 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggacccccttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatag

SEQ ID NO: 435225 - DNA, 8509 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaacgtggaatctgttttctcaccttctgttctcgatttcccatctgtgatctgactggagggtgggtgctacacaccaacttcaaatgatggcgccaggccctttttgctgagggcgctgtctcccaggtcagacgacagaataattctcaggccagtcctggctccaactcttgttcctgccagtgcctcacaggatgcacacgcactaggaagggaaagaccacccaaaggcaggagctggcccacctgtcaagggagtgatttaggagggctctggtcaccagccaatgaagctcactgctgggttaggacattttcaggggtccagtacatttcaggctgcattttcaggcagacacgcattgaagatgcttttggaggattcagtgatgaggccaagggcagcctctctagtgcgggccaactaggatgagagaaatactagggcagcacagaatcaaacagagaatgccgatttcttgttccataatattctccggttagactggttctgggggtaaggggtctatgactaggcttcttggcagcagtggaaacgtgtgaaatgggccgaagtgccctcttcctcctgtgccactaccataggagaggaaaggtgagtcacaggtatggtgcttcagcagggctcccacccccacatccagtatcttatccaagagtgtacagaattcagaggcttgtttttctcaaaaagtaagaactctgggctgggcatggtgctcacgcctgtaatcccggcactttgggaggccaaagcaggtggatcatttgaggtcagaagttcgaatccagcctggccaacatggtgaaacaccgtctctactaa

SEQ ID NO: 435226 - DNA, 7278 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatg

SEQ ID NO: 435227 - DNA, 4970 bp, Homo sapiens
atcattttcttcttaccggagaggtgttgcctttgatacaccccgatgaacgtatgatctgtgcaagccctgaaagtggattgttgaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatag

SEQ ID NO: 435228 - DNA, 4407 bp, Homo sapiens
  misc_feature (27)..(27): n is a, c, g, or t
  misc_feature (39)..(39): n is a, c, g, or t
  misc_feature (46)..(46): n is a, c, g, or t
  misc_feature (53)..(53): n is a, c, g, or t
  misc_feature (55)..(55): n is a, c, g, or t
  misc_feature (74)..(74): n is a, c, g, or t
  misc_feature (81)..(81): n is a, c, g, or t
  misc_feature (101)..(101): n is a, c, g, or t
  misc_feature (105)..(105): n is a, c, g, or t
  misc_feature (117)..(117): n is a, c, g, or t
agaggcggaagatgtctccggcaaaanaaaacaaaacanaaacctngctaagnangcggaggtcagaaagatangaagaangacagagacagacatacatngatngagtgatagatngaaagacagggagaaagagaaacagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatag

SEQ ID NO: 435229 - DNA, 3984 bp, Homo sapiens
tcggcctggcggtccctcggctacttgtctctcggctctaccttgtccctcggctctaccttgtctctcggctctaccttgtctctcggctctaccttgatctccaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatg

SEQ ID NO: 435230 - DNA, 3584 bp, Homo sapiens
gttgccctttacgacaaaaaaaacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatg

SEQ ID NO: 435231 - DNA, 7524 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgtgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatag

SEQ ID NO: 435232 - DNA, 8387 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaacgtggaatctgttttctcaccttctgttctcgatttcccatctgtgatctgactggagggtgggtgctacacaccaacttcaaatgatggcgccaggccctttttgctgagggcgctgtctcccaggtcagacgacagaataattctcaggccagtcctggctccaactcttgttcctgccagtgcctcacaggatgcacacgcactaggaagggaaagaccacccaaaggcaggagctggcccacctgtcaagggagtgatttaggagggctctggtcaccagccaatgaagctcactgctgggttaggacattttcaggggtccagtacatttcaggctgcattttcaggcagacacgcattgaagatgcttttggaggattcagtgatgaggccaagggcagcctctctagtgcgggccaactaggatgagagaaatactagggcagcacagaatcaaacagagaatgccgatttcttgttccataatattctccggttagactggttctgggggtaaggggtctatgactaggcttcttggcagcagtggaaacgtgtgaaatgggccgaagtgccctcttcctcctgtgccactaccataggagaggaaaggtgagtcacaggtatggtgcttcagcagggctcccacccccacatccagtatcttatccaagagtgtacagaattcagaggcttgtttttctcaaaaagtaagaactctgggctgggcatggtgctcacgcctgtaatcccggcactttgggaggccaaagcaggtggatcatttgaggtcagaagttcgaatccagcctggccaacatggtgaaacaccgtctctactaa

SEQ ID NO: 435233 - DNA, 7524 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatag

SEQ ID NO: 435234 - DNA, 7580 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgccagctatgctaatgacagaaaacataagagcctgtagctcatatcacgctccacaggagtccaagtggtatggcagtcagtcagaggctacgcctcacggttagtagtcaatcctctgatcctatgcgatggactttcaaactcaaacggtctgggtaatgagcaataccttaaataaggtggaatatgtcctgaagattagtaatagtgtatgctcccccggtataagctgttcagtcagtagtccagcccacccctagccccaagtatcttgtggtgaatacccatatttttatacaacaaattaaggaatacaaataatctcttcaaaagacaa

SEQ ID NO: 435235 - DNA, 2492 bp, Homo sapiens
gagagtctggaagcagaaatccgttcaagttgacagagtaggtaacgttggcgctcgagtctggaggctgagtcgccgcgcgagcacggccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatg

SEQ ID NO: 435236 - DNA, 7227 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgacgactcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacattcctgtgggtttggaatcttggattttccccctttatgaactgtactggctgttgaccaccagacacctgaccgcaaatatcttttcttgtattcccatatttctagacaatgatttttgtaagacaataaatttattcattatag

SEQ ID NO: 435237 - DNA, 6776 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgagcatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatg

SEQ ID NO: 435238 - DNA, 6647 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatacagacacacacaggacacatatattaaacagattgtttcaacaagaacaaaacaaaaaaaaaaaaacaaaagaacaaaaaaaacaagaacaaaaaaaggggggggggcccacaaaaagctccccccgggggggccccaagtatgcggcgccccccactatgttgtggacaacagcaggggcacccccaataaggagagagggtgcgaatataatacacgcgaaccggacgcgcggcccgcgcgcgagctaaaccaacagagacttgccacgacgtgcgcaacaaccaagcgcgccataccgaggggacacccccacgtggagaaagagaaccacccataatccacggcgggggggcggccccacactggggggcgacgcagatcgagt

SEQ ID NO: 435239 - DNA, 6199 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggctgaggtgagcaggcatgcggccccgagctgacaggcagctgctttgtgggttagcttaggctcggggtgcagctggtcagaggaagtttacttagatccatacccagtgacccattctttctcccgaaccacttcatttaagatttctgacctttatagtcgtccttggggagaataaaagaggaggcggccctattcattgccagtcactagaggaccacactaatccaccacaccaggcgctcctccagctcctcgtcatacttcttctc

SEQ ID NO: 435240 - DNA, 5430 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtctccgtcgaactagttcgacggagactctctgtcagccccagacctttcttattcacttgacatgatcaaaacggaacctctgcttcctgcccacacccctcccactatcgcagatgttaagtgtctccatctcaataaacggcaccaccattcagtagttgctcaggcaatcttcgggtccttacattttattcctctctccccccacatctaatacagtaggctgtcttgttggggagagagtctccgtcgaact

SEQ ID NO: 435241 - DNA, 2887 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccagtgaaggttatcggatcatcccgggcggcacctacaaccagggccagaacggttttgatctggtgttccaggggccgagcaatgcggtgtatctgctggaggtcaagcacgtctcaacagccagcggtggccgtttttccaatgtgaacatggcgcgggtgatcccgcgaagaagaaaatgatccgggtcgagctcata

SEQ ID NO: 435242 - DNA, 2661 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaatactacgccaagaagcagcagcacgtgagtgatcaaaagttctaccataaggcctatggcggtgcgctcaactttctgcactggcagtggtggagtgatagctctaaagtc

SEQ ID NO: 435243 - DNA, 2444 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatctactcaaatgctatcctaaggtttatggatggaacaggcctgtgaccgatgaccgggcttagattggccaacttgtcagattggcagacaggattttcaggctgggtctgcacct

SEQ ID NO: 435244 - DNA, 2190 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgttcacatactatgaaagaagtagactgcaagtatggagtgggaggagagaaaagattatgctagagacagcataagcaggaatgaaaattctacggaactccaaaggaagagatctctaaattcagtcctctttggcgttggggaatgctgacagtgttgaaatggacgggggaagcttggaggtag

SEQ ID NO: 435245 - DNA, 466 bp, Homo sapiens
ccatgccccatgtcctcacagctctaggaaacaggaatgcctgcttagtcctctgtacctcttagcaaccaccccatgcccgctctgtgcctaccccagcctttattacatggttaccgtattgtcttgggtttttccatcttggcttcatctacaccgagctcaggtcactggctgccttctcgcatgccctcgtagcagtcagtgggatggtttgtactaggtggtggtgtttaaagacccctttgaacaaaattcagctactgtggttttctgttgatagtaactgtttggtaacagagacctctacagagtaacagaagtttccactcacccgagtaaccagagccccccacttgagaacagtctgcctgttctgcgagcagatacttggatgtaacccagcataacccgatgttgtccattaggtgcgggagctcgaggcggagctggaggatgagaggaa

SEQ ID NO: 435246 - DNA, 595 bp, Homo sapiens
tattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaaggtaattggaaatatttgaatactaaatgctcagaatttcttaaatgtaatttactgttttttaatgtctcaatgtattctacaaaagttaaattttatttttttaaaattaataaaaaagtaatgtttattgtagaaaaattgagtttttaagattaaaacagacaacacagccattttctgtaagtatgataagtatgtttgttgctctaaaacaatacctcataaatttgtatgttaaaaagcatctagttttcatatacatttgattcccaccacaaggcggtctaaccaaagctcattatattaggttttaaaaccaataggaagaataataggaaaggtagatgctgcactggggaaagaaaaattgtaaagtattatttgtgatttaaatgcatgtaaaagggtgacaataaaagttaaaaagcatgtgttaagt

SEQ ID NO: 435247 - DNA, 493 bp, Homo sapiens
aaaacatatgctagtatttaaaactgatctaggtcagatgctaaagattaaaccatgaaactattgtttgcttgattaggctggaaaattggatccacacctagtcctagatcagcttcgctgtaatggtgtcctggaagggatccgaatctgtcgccagggcttccctaaccgaatagttttccaggaattcagacagaggtattgctaacttttactttttttgcttatgtatcagagtttatcttgatatgaattaaaacagtgataaaataaggaaatctttttccttgtcccctacatagtttgttttcttatatagcaaacatatagtgaggttctggaaaagggacaatccttactaccttgattattggtaggaagattgagtgcctactttataaaaagggagtgtgctaggaactgctatgggcgctgcaaagaaacatgccatgttttcagggccctgaagttagctttgagataaacatag

SEQ ID NO: 435248 - DNA, 818 bp, Homo sapiens
  misc_feature (644)..(644): n is a, c, g, or t
tatctttaacatgtattacccaacattttattgcctcttagagcaaaacacacagttagtagatacacatcgttcacaaatttctacaaaatacttcttggaatattctcttacagatatgagatcctaactccaaatgctattcctaaaggttttatggatggtaaacaggcctgtgaacgaatggtaaggttttcttgatctttttctggcttgtagatttaatctaatctttcttgtagttaaaaaaagtaaataaactctttctctcttagatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaagtgagtgggtattcacgaattaatcgttcactgaggaagtgcttgtgctagataagcattgcattttgacctggggtgcaagagtgtgtgagacatagtctgtccttacagaagttgctttatagtggcagagatagtcaggtaaatacatgaacattctaagtaatgggatgttgcaatacaaaaacacacaaggaggctgggcgtnggtggctcaggcctgtaatcccagcactttgggaggctgaagtgggcagatcacttgagctcaggagttcgagaccagccagggcttcatggcaaaaccccatctctactaaaaatacaaaaattagccaggcttggtagcatgcgcctgtagtcccagctacctgtgggagct

SEQ ID NO: 435249 - DNA, 447 bp, Homo sapiens
tgtacgacatgaattctttaatacaggtgtatttgttttggtgataaatgtaatggaagtgttgccctttacgacaaaaaaaacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccaggtgtgcgtcctctttaggaggccgcggtggcctcgatgtgtgccttcagcagatcctggccctgctgtgctgggctgtctcagctccatttgggacagttaattaggtcgtactaaattaagcccattaaatggtttttcttgacccagccacatgctggttataatgctggaagcccttaaaataaggacctaggactgtgtcaa

SEQ ID NO: 435250 - DNA, 2913 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435251 - DNA, 1508 bp, Homo sapiens
tttacggctatcgtcgcccacgcgtccgggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435252 - DNA, 992 bp, Homo sapiens
caaaattacggctaggtacgaggcctgggttggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccagggcaccaggagccattcaggactggcagggtgacgcagaaccgaggagggggacagccggagcggcggagtggaaccaggtggcacaccgcgtgcccgaag

SEQ ID NO: 435253 - DNA, 5614 bp, Homo sapiens
  misc_feature (2752)..(2752): n is a, c, g, or t
  misc_feature (2779)..(2779): n is a, c, g, or t
  misc_feature (3763)..(3763): n is a, c, g, or t
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccaggtacactgccccgtccaggcctccctcctcagtgggctctgcctcttggtcaggccttcactagcttcctccctgtgctgggaactccaatgacccagacagccctgggcctgtccgcaacggggctcacggtccagtgcaagagacctgttcccagacagtgatgggcagagtggttggggctgggagcccagacggggcacctggcccagcctggggggtcaggaagggctcccgggaggaggggtcgcctgagccgaggcagaggctgagggaggggtttgcagtgggaggaggggagtgggttttccaggtggtgggaacagcactgcaaaggcacagagttgagagagaccgtggcgccttccaggaagcctgtggggcagagatgaaaaaggctgtggtgacacggtggcacactggcagccaagtgacagttatatatgggcgaggctagctcagcgatgggaaagtctagctggagccactgtgcatttagcgggcatctgttgagcacagatgctgtggacaaaggggacaaaaacccctcccttggccgggtgnggtgcctcacacctgtaatcccagcantttgggaggctgaggcgggcagatcattggaggtcaggagttggagaccagcctgaccaacatggtgaaaccctgtctctactaaatacagaaaattagcagggcatggcagcacgcatctgtggtcccaactgcttgggaggctgaggtgggaggattgcttgagcccaggaggtccaggctgcagtgagctatgatcgcaccacggcactgcagcctgtgtaacagagcgagactcaaaaaacaagcacaaccctccctcaaggaacagcccttctcatggggtcacgtgactggagagatgctgagatgtttgcggtagatgcaggacgcttgtccgaatcgttttcagcattcataagaaggagatagctagccaggaacagaggcagcttcctcatctggtagagaaaagtgtctgcggaaaaaagcaacagtgtgctcatggttgaaagcgtgagggtgccgctcactgccatctgttcctggaccagatgtgggagggggcgtggagatcagacattcgcttttagatttgtacagaactacttcgtagagataaaattcacttaaccatacggtcagcctagttagagtatgtgattcagtggcttttagtgaccattgtgtaaccatccccgcagtcaattttagaacattttcactgtccgtaaaggaaacctcacacatgtcagccatcacccccgcaattccctgtctcgtgtggtcttgggctgccaggcttcctgtctcagggaccagcccaccctgaccaattcacatagatgaaactgtgggccgggcatggtggctcacacctgtaatcccagcactttgggaggccgaggtaggtggaccacctgaggtcaggagttcaagaccagcctgaccaacatggagaaaccccatctctactaaagttacagaattagccgggtatggtggcacatgcctgtaatagtagctactcgggaggctgaggcnggagaatcgcttgaacccaggaggcgggggttgtggtgagctgagatcacaccattgcactccagtctgggcaacaagacagaaactctatctcaaaaaaaaaatgtgaagcgtgcaggtcagactgccttcacagacgtgcagagcaggtgtgagggcgagggtttgaggtgccctctggctctgtgcagggtgggtgtgctggtagacggggtgtggggaggaaagcctgggccggggcgggatccacgggcactggatgagggacagatgggaggtaagagggtctagtctcagtgtcccaggaggggttcagggacccatcctcactcccgcccctcagaccctgctctcagcggcccacgaggtggagttgcagcggcagaaggaggcggagaagctggagcggcagctggccctgcccgccacggagcaggccgccacccagggtgagccccgcacctgcccactccctcccctccccgggcctcctacccacccctgacactgcaccccgcctccccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaaggtgctcactgtgtcctgccgtggagccccgtgcccagtgatgacaccatccttgctccccgtgccccccaggggctatgggcgacaccatggctgcccctgggctgggccagtggggccaatgcccaggggctgagggcacgggatgctgggatgagatcccagggtgaggggccaggctaaggtttgagtccgggaccctaagaaggcctttccttccagctggtccctgttgcagtcccggtcacctttaggactagagggaccttcctgaagctcagaaccaaccctgtccctcccctgctcggaacctgctgtggctccccagtgcccctgaggaagcccagctcctctgtcagccacacgcctgggccgacccggccgtggggctccagccagttgtgctcatgagcggactgtgccttctccctctgatccagcctttgccctcgctgtccccttttctgtgtcgtcaccagcccacttcccgtgactcctctaagcccagcttagagatggccataggttggtggctgtcatcccaacactgagccccagcagctgagggccaggctgagtccctggtgcccacaggctgccctggggggagactgcatggggctgagccctgccaggaccccgaggagaggtccaggcccttgggcttctgccaggccctgctgaggcctccctctctgtcctgtagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435254 - DNA, 290 bp, Homo sapiens
cgcggccgcgcgacacgacagaagggtcagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435255 - DNA, 678 bp, Homo sapiens
  misc_feature (20)..(20): n is a, c, g, or t
gcaggagtccacattccagngtggcggcctgctccgtggcgggcagggcgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435256 - DNA, 687 bp, Homo sapiens
acctcgcttagtgctccagggggttgtctgaggcccagaggtcgtagaagggccgctctacggtgtcctggggcccgggcttggcccttgttgcagaagggttgaggagccggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435257 - DNA, 344 bp, Homo sapiens
ttcggcacgatggcaggccgccacccaggaggccgggaggccggcgggaggctaggtgacaacccgaagctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435258 - DNA, 3011 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctgaaaaaaaaaaaatggggatatatagggggaaacggatgagggacagggaagaggtacggaaggttttgcaggggatgggccccaaggggtatagaacag

SEQ ID NO: 435259 - DNA, 1511 bp, Homo sapiens
caaaattacggctaggtacgaggcctgggttggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435260 - DNA, 3474 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctgaaaaaaatacaaaaaaaaagaagaataaataaaaaaaggggggcggcggcggcaaagaagctattctccgcccgcagggggcgcccagagtagtatccgcgcgtataccccgtgtttgtcgtcggtacccaaagaggtgggccccacatagaggaggaggcgcgtgatataagaggcaacggccaaggggccggcaggtatacaacagcgtcgagaacgtggggaagaacacgcgggcacaccgtgggagccacctgggggcgaagcggaaccccataaacatcggggggggggggcgaacaataacgtggggcaccaaaacttaccactaaaagagaacgaacttttacaaagcgggcctactagagggggaaacatctatataacacatgtcttctagaagggggggataatacgggggggtgtgtcaaaacaatagggctgggacattaatgtgtgtggagagagctttgggaaaaagtttgggggcataaaggtggatattgatgagtttttgagtgaaaaatatttttatcccggggagctagtggtgaaatatgag

SEQ ID NO: 435261 - DNA, 2918 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagtttaaaaccaaggccaaaggtgaaacttggtggaagaaaccgggcgtttcgtgagaatccaaattttaacttgcattaaaatgcccggaaaactttccctttaaattaaaaaaaatttttt

SEQ ID NO: 435262 - DNA, 2861 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcatacgcaagtacaaatgaagctaggtgagaagcggcgttaacgacgactgccagttatagc

SEQ ID NO: 435263 - DNA, 3836 bp, Homo sapiens
  misc_feature (3250)..(3250): n is a, c, g, or t
  misc_feature (3267)..(3267): n is a, c, g, or t
  misc_feature (3269)..(3269): n is a, c, g, or t
  misc_feature (3533)..(3533): n is a, c, g, or t
  misc_feature (3537)..(3537): n is a, c, g, or t
  misc_feature (3548)..(3548): n is a, c, g, or t
  misc_feature (3588)..(3588): n is a, c, g, or t
  misc_feature (3659)..(3659): n is a, c, g, or t
  misc_feature (3663)..(3663): n is a, c, g, or t
  misc_feature (3679)..(3679): n is a, c, g, or t
  misc_feature (3690)..(3690): n is a, c, g, or t
  misc_feature (3695)..(3695): n is a, c, g, or t
  misc_feature (3702)..(3703): n is a, c, g, or t
  misc_feature (3755)..(3755): n is a, c, g, or t
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaaggtgctcactgtgtcctgccgtggagccccgtgcccagtgatgacaccatccttgctccccgtgccccccaggggctatgggcgacaccatggctgcccctgggctgggccagtggggccaatgcccaggggctgagggcacgggatgctgggatgagatcccaggcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctgagatcagtgggctccacgtgtggcttgtgtgcctcctgcgggcggctgctcccgggtgcagactctgcgtgtccccccgtggcgcacaagcatgtaggtgccagaactcaccgccagagcctgaatctcgctctgtcacccgggctggagtgcagtggcgcgatctcgactcnctgaaacctccgcctcncnggttcaagcaattcttctgcctcagcctcgccttgtggttttatagatggtttttgtgaaaatgaataatgttcgaaattgtattcattaatataagcgactctgtctcaaaaaaaaaaaaccaaaatcattattggtaagatacatagaatgtcagaggtgacgagggccatgaggaagagggggcacagaatgttgggggaggggttgcagttttaaataggatgtcaggggaggtcacagtgaaaagtgacattttggccnggcntggtggctcangcctgtaatcccagcacttggtgggaggctgaggcgggcngatcatctgaggtcaggagttcgagaccagcctggccaacatggtgaaaccccgtctctacttttataaanattngctgagtgtggtggcnggcacctgtantcccngatactnnggaggctgaggcaggagaatcgcttgaacccgggaggcggaggttgcagtgngctgagattgtgccactacactccagccttgttgtccagcactccaggcaacaagagcaaaactccatctcaaaaaaaaaa

SEQ ID NO: 435264 - DNA, 2848 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435265 - DNA, 2784 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435266 - DNA, 3618 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaaggtgctcactgtgtcctgccgtggagccccgtgcccagtgatgacaccatccttgctccccgtgccccccaggggctatgggcgacaccatggctgcccctgggctgggccagtggggccaatgcccaggggctgagggcacgggatgctgggatgagatcccagggtgaggggccaggctaaggtttgagtccgggaccctaagaaggcctttccttccagctggtccctgttgcagtcccggtcacctttaggactagagggaccttcctgaagctcagaaccaaccctgtccctcccctgctcggaacctgctgtggctccccagtgcccctgaggaagcccagctcctctgtcagccacacgcctgggccgacccggccgtggggctccagccagttgtgctcatgagcggactgtgccttctccctctgatccagcctttgccctcgctgtccccttttctgtgtcgtcaccagcccacttcccgtgactcctctaagcccagcttagagatggccataggttggtggctgtcatcccaacactgagccccagcagctgagggccaggctgagtccctggtgcccacaggctgccctggggggagactgcatggggctgagccctgccaggaccccgaggagaggtccaggcccttgggcttctgccaggccctgctgaggcctccctctctgtcctgtagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435267 - DNA, 4179 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaaggtgctcactgtgtcctgccgtggagccccgtgcccagtgatgacaccatccttgctccccgtgccccccaggggctatgggcgacaccatggctgcccctgggctgggccagtggggccaatgcccaggggctgagggcacgggatgctgggatgagatcccagggtgaggggccaggctaaggtttgagtccgggaccctaagaaggcctttccttccagctggtccctgttgcagtcccggtcacctttaggactagagggaccttcctgaagctcagaaccaaccctgtccctcccctgctcggaacctgctgtggctccccagtgcccctgaggaagcccagctcctctgtcagccacacgcctgggccgacccggccgtggggctccagccagttgtgctcatgagcggactgtgccttctccctctgatccagcctttgccctcgctgtccccttttctgtgtcgtcaccagcccacttcccgtgactcctctaagcccagcttagagatggccataggttggtggctgtcatcccaacactgagccccagcagctgagggccaggctgagtccctggtgcccacaggctgccctggggggagactgcatggggctgagccctgccaggaccccgaggagaggtccaggcccttgggcttctgccaggccctgctgaggcctccctctctgtcctgtagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctgaaaaaaatacaaaaaaaaagaagaataaataaaaaaaggggggcggcggcggcaaagaagctattctccgcccgcagggggcgcccagagtagtatccgcgcgtataccccgtgtttgtcgtcggtacccaaagaggtgggccccacatagaggaggaggcgcgtgatataagaggcaacggccaaggggccggcaggtatacaacagcgtcgagaacgtggggaagaacacgcgggcacaccgtgggagccacctgggggcgaagcggaaccccataaacatcggggggggggggcgaacaataacgtggggcaccaaaacttaccactaaaagagaacgaacttttacaaagcgggcctactagagggggaaacatctatataacacatgtcttctagaagggggggataatacgggggggtgtgtcaaaacaatagggctgggacattaatgtgtgtggagagagctttgggaaaaagtttgggggcataaaggtggatattgatgagtttttgagtgaaaaatatttttatcccggggagctagtggtgaaatatgag

SEQ ID NO: 435268 - DNA, 2655 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggaacttgctccgttgctgtagcctgcttgtggcccatttgaaggtttaggctgacagtccccaaggctgtaacgcttaagttc

SEQ ID NO: 435269 - DNA, 2554 bp, Homo sapiens
  misc_feature (2487)..(2487): n is a, c, g, or t
  misc_feature (2494)..(2494): n is a, c, g, or t
  misc_feature (2497)..(2497): n is a, c, g, or t
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcnaggccgnttngggccgcccgcttctccaccagcttcaccttgtacttgcgtttgaacttggctctct

SEQ ID NO: 435270 - DNA, 2685 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacgtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435271 - DNA, 3025 bp, Homo sapiens
  misc_feature (2656)..(2656): n is a, c, g, or t
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccactgtggccacacacgaggagaatgaatgactgtgatgctgcatgctggctgtgctgtggatgaatgtgcttgtgtcacagggcttgctgtgtgtaccatgcatgtggcctgctgatttgctgtgtgacctggccctgtgcttcctgtgcaacctatgtgatgcctttgttacctgtgcattgctgctggtgtgattcaattgtgcccatgtgttgtgccccatagatgtgctngtgctgtgatgcattggctgctgtgctggcatgagtgcgtgctgtgcagtgcgctggctgtgtgagtgcttgaggctgacaagccccgaaggcttggggcggctcaatgtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435272 - DNA, 2653 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435273 - DNA, 2575 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatgctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435274 - DNA, 2394 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccagggcaccaggagccattcaggactggcagggtgacgcagaaccgaggagggggacagccggagcggcggagtggaaccaggtggcacaccgcgtgcccgaag

SEQ ID NO: 435275 - DNA, 2462 bp, Homo sapiens
  misc_feature (2344)..(2344): n is a, c, g, or t
  misc_feature (2347)..(2347): n is a, c, g, or t
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccagaggggtcactccaggagctgtggagggtgtggagggagcgtggggggggcngcngggaggccgggggatcgggtgcacccccggtggccaagaaaatggcgggggaagggcactgggcaagcgtgggcgctcccaaatttgggaacactagggggggggagcaggatat

SEQ ID NO: 435276 - DNA, 4831 bp, Homo sapiens
  misc_feature (2752)..(2752): n is a, c, g, or t
  misc_feature (2779)..(2779): n is a, c, g, or t
  misc_feature (3763)..(3763): n is a, c, g, or t
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccaggtacactgccccgtccaggcctccctcctcagtgggctctgcctcttggtcaggccttcactagcttcctccctgtgctgggaactccaatgacccagacagccctgggcctgtccgcaacggggctcacggtccagtgcaagagacctgttcccagacagtgatgggcagagtggttggggctgggagcccagacggggcacctggcccagcctggggggtcaggaagggctcccgggaggaggggtcgcctgagccgaggcagaggctgagggaggggtttgcagtgggaggaggggagtgggttttccaggtggtgggaacagcactgcaaaggcacagagttgagagagaccgtggcgccttccaggaagcctgtggggcagagatgaaaaaggctgtggtgacacggtggcacactggcagccaagtgacagttatatatgggcgaggctagctcagcgatgggaaagtctagctggagccactgtgcatttagcgggcatctgttgagcacagatgctgtggacaaaggggacaaaaacccctcccttggccgggtgnggtgcctcacacctgtaatcccagcantttgggaggctgaggcgggcagatcattggaggtcaggagttggagaccagcctgaccaacatggtgaaaccctgtctctactaaatacagaaaattagcagggcatggcagcacgcatctgtggtcccaactgcttgggaggctgaggtgggaggattgcttgagcccaggaggtccaggctgcagtgagctatgatcgcaccacggcactgcagcctgtgtaacagagcgagactcaaaaaacaagcacaaccctccctcaaggaacagcccttctcatggggtcacgtgactggagagatgctgagatgtttgcggtagatgcaggacgcttgtccgaatcgttttcagcattcataagaaggagatagctagccaggaacagaggcagcttcctcatctggtagagaaaagtgtctgcggaaaaaagcaacagtgtgctcatggttgaaagcgtgagggtgccgctcactgccatctgttcctggaccagatgtgggagggggcgtggagatcagacattcgcttttagatttgtacagaactacttcgtagagataaaattcacttaaccatacggtcagcctagttagagtatgtgattcagtggcttttagtgaccattgtgtaaccatccccgcagtcaattttagaacattttcactgtccgtaaaggaaacctcacacatgtcagccatcacccccgcaattccctgtctcgtgtggtcttgggctgccaggcttcctgtctcagggaccagcccaccctgaccaattcacatagatgaaactgtgggccgggcatggtggctcacacctgtaatcccagcactttgggaggccgaggtaggtggaccacctgaggtcaggagttcaagaccagcctgaccaacatggagaaaccccatctctactaaagttacagaattagccgggtatggtggcacatgcctgtaatagtagctactcgggaggctgaggcnggagaatcgcttgaacccaggaggcgggggttgtggtgagctgagatcacaccattgcactccagtctgggcaacaagacagaaactctatctcaaaaaaaaaatgtgaagcgtgcaggtcagactgccttcacagacgtgcagagcaggtgtgagggcgagggtttgaggtgccctctggctctgtgcagggtgggtgtgctggtagacggggtgtggggaggaaagcctgggccggggcgggatccacgggcactggatgagggacagatgggaggtaagagggtctagtctcagtgtcccaggaggggttcagggacccatcctcactcccgcccctcagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435277 - DNA, 2800 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435278 - DNA, 3326 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacagtgagtgatcctgctgtcacctatgaatggggacaggacggccatgtgcagtttgtgtgtgttgtgcactgcacgagagtacagtgtgaaagggagtgctttgtgggtgctttggtgacctcccagcagagtcgtgcgtcctgaaggggcggccgtttcccactcgtgcttttcctttcctgagttgtgaggcttcaggaaaggaagccttcagctttggtctcttccactttctgaacccgtccagacacagttttgtcctggtgatcaaggcccttggggtctagaatcagtccttcccttgcctgagcttcagggtcagcctttttgaaatgtggagggactgggggggagcctttggtgcctcttccatgctgggactgtcccagcagctcccctcgctgtatccacagaccccctggacaggccgttggttggccaggatgagtttttcctggagcagaccaagaagaaaggagtgaagcggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435279 - DNA, 2740 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgccggcagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435280 - DNA, 2448 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagcacgcctgcacaccaagccgtcccaggcgcccgccgtggagcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435281 - DNA, 2401 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435282 - DNA, 2285 bp, Homo sapiens
  misc_feature (2118)..(2118): n is a, c, g, or t
  misc_feature (2125)..(2125): n is a, c, g, or t
  misc_feature (2137)..(2137): n is a, c, g, or t
  misc_feature (2152)..(2153): n is a, c, g, or t
  misc_feature (2165)..(2165): n is a, c, g, or t
  misc_feature (2168)..(2169): n is a, c, g, or t
  misc_feature (2189)..(2189): n is a, c, g, or t
  misc_feature (2191)..(2191): n is a, c, g, or t
  misc_feature (2198)..(2199): n is a, c, g, or t
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggcagacgcctgacaccaagcgtnccaggcnccgcgtggaggngggcctgcgagttcnnaaatccatcttngannacacagacctgtctcagggncncgagggnnttgcgggcaagggcgggaaatgagggggggcctggccgcaggggggcgcaccgggtccatccgaagggcacggggggacctggggg

SEQ ID NO: 435283 - DNA, 2275 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccatggcctccatgactttttccaaaaaaaaaacaaaaaaaaaaaaaaaaaaaaggggggggaggatataagagaatactgtcacaataagggatgccaccaatattggcagttatacccggtattctttgcaacaagagtggggcccccataaagagagcaccaaatataaaaagtagaagccactgtagccgcacgttgcacaaatgtacacgaaagctgaaaactgtgctctgtggtactttgaaag

SEQ ID NO: 435284 - DNA, 2423 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435285 - DNA, 1843 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435286 - DNA, 1974 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaaggtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctga

SEQ ID NO: 435287 - DNA, 1843 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagaagtgagtgtcccagcatccct

SEQ ID NO: 435288 - DNA, 2065 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctgaaaaaacaaaaaaaaaaaaaaaaaaaaggggggggaggatataagagaatactgtcacaataagggatgccaccaatattggcagttatacccggtattctttgcaacaagagtggggcccccataaagagagcaccaaatataaaaagtagaagccactgtagccgcacgttgcacaaatgtacacgaaagctgaaaactgtgctctgtggtactttgaaag

SEQ ID NO: 435289 - DNA, 2127 bp, Homo sapiens
cctcccgagtacctgggactacaggcgcacaccatcacgcctggctaatttttaaatttttggcagacacaggatctcactatgttgcccaggctggtcttgaattcctgggctcaagcgatcctcctgcatcggcctcccaaagtgctgggattagaggcgtgaatcaccacgccctgccatggatccctttgaatggctgccagggcccaagagcctctgagcttccttccttatttgtaaatgacaaagatgagttgattctaagatgaagcctcagagggcaaggcagtaacaatagctaacactcagatgccagacgcagccttaagcgctttacatatgtttaatcttctgcatgacttatgacgcagatgtactgttatcatctttattttacagatgaggaaactgaggcacagtgaagtagcccgctcaagatgaatgattctgagtctgcacttctagggtcctaaaagtgtatgtttctaacattcctctaatgttctgtgcttccaactttgatattccgaaagttacttgatttctaagatcctaggattggaacatttgagaggacaaaacttctgagattggaatgtgtgttgtgcggaatctgccactgacggttctgactttctaagaaaacgagattaaaaaataatcaggccgagcatggtggctcacatctgtaatcctagcattttcggaggctgaggagggagaatcacttgagcccaggggttcaagaccagcctggacaacatagtgagacctttgtctcttaaaaaaaaacacacacacatcagtttggaccgggagtggtggtgtgagcctgtaatcccagcgctttgggaggcctaggaaggaggatcacttgaaaccagatgtttgagaccagcctgggcaacatggggaggctccatttctacaaaaaataaaaataaaaaattagccaggtgcggatgcacccttcttgtggtcgcagctactcgggaggctgaggtaggagaatccctgagctcaggagttggaggctgcagtgagccattacccttccactgcactccagcctgggggcaacaaagtgagaccctatctattaaagaaaaaaatcagtttgagcaaagaccccaggcggccgggaaaggtgttcgcttaagggcgaaagctaagaacctgcaaccttcccgtctctttcctaccacccgccgccgttaggaatcttcagatcccgctgtaaagaatggaggaaggaggagccatttatcctttaccaagatggcagcctcctggcaactccagtcactttataaatatggctgccacaggaagtacgtcacggaagagggtgggaaatctgcgcgcgcacgctgcaaaggggctttttgggacgccagtggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggacggagtctcgctctatcgcccaggctggagtaggcgcgatctcagctcaccgcaacctccgcctcccaggctcaagcgattctcctgcctcagctccttagtagctgggattacaggcgggcgccaccacgctcggctatttttcttttcttttcttttttcttttttttttgagacggagtctttctctgtagtccaggctggagtgcaatggcacgatctcggctcactgcaacctctgcctcctgggttcaagtgattctcctgcttcagcctcccaagtagctgggattacaggcatgcaccaccacgtccggctaatttttgtatttttagtagagacagggttttgccatgttacaggccaggctggtcttgaactcctgaccttaggtgatccacccgccccggccccctaaggtgctaagattacaggtgtgagccaccacacccagcctaatttttgtatttttagtaa

SEQ ID NO: 435290 - DNA, 355 bp, Homo sapiens
ggtgagatgtgtgggaagggcatcctgggtgatgggagggtgaggagggccgggagctgctctgtgttcctgcagtagagtctgtctcagagcccttccatcccagtggccgagaactctgtgctggagccaggtggctgggattcctgtcccagctccagtgctgactgatcctgggaaggtggtctcacctttctgcaacctatatcttcctctaaaatgcagatgagggccgggcatggtggctcacgcctgtaatcccagcacttcgggaggccgagacaggtggatcacctgaggtcgggagtttgagaccagcctgaccaacgtggtgaaaccctgtctctactaaaaa

SEQ ID NO: 435291 - DNA, 1959 bp, Homo sapiens
  misc_feature (1097)..(1097): n is a, c, g, or t
ctaggtaggaagggggcctgctggttggttggggcttcatgatacttgcagtggtggaggcagctgttgggggttcttagaaatagagtcctccagccagctctaagggcttcctgccctggcctcagccttagcaggccagagtgagcagtgggcagaaaccttgacctcacttaatatggccttcgtccaggtgaagcagaaagagctgtgtctgcccttcgcttgggtccgtgtgagagcaaggcctttggcaagcctgtgtcgtgcctgtaccactggggctgcctcccacaccctcccctgcacacccctagtgccgcagtaagcacgcccaccattaaagcagaccaggagttactaacctgcctgccttcctcagaggctcagtgttgagttggaagagaggggttttacagtgggccagtccttaaggtggtgtgggtgctgggctgtggttgtggccttaggtctgctggcgggtgtgctgcacctccttggcctcccctctcctgggctcaaggaagtaaacaagtcctctgtatgatggggaggccaggacctctcgtccctttaaggcagcttggtgcctgccagtcacctcagcgggcggcagtcagtgggcttgtgtgcatctgtaaactcagcactttgggaggctgaggcaggaggattgctggagcccaggagttcaagaacagcccaggcaatgtagtgagaacccatctctacaaaaaaataaactaggctgggtgcggtgggctcacgcctgtaatcccagcattttgggagacggaggcaggcggatgacctgaggtcaggagctcaagaccagcctgggcaacatggtgaaaccccgtctctactaaaaatacaaaaattagccgggggtggtggcgggcgcctgtaatcccagctgctcgggaggctgaggcaggagaagcgcttgaactggggaggcagggttgcagtgagccgagatcgtgccattgcactccagcctgggtgacaagagcgaaactccgtctcaaaaaaaataaattagccgggcctggtggtgcacacctgtggtcccagctactcaggaggatggcttnaacccaggacatcaaggctgtgcagtgagctgtgatctgggcaacagagtgagaccccatctcaaaagggaagctcgagggctctgctttgtgtgctggtgacagtgttctcaagccagttctgcccaagagccaacagctctcgggaccccacggctccaggacagggctccttccctagaatgtgctctatctcaggaatcctctttcgaggatctgtgacgggatctaggtcagggaatgtcccccctgtctctggcaagccaggctccccttggccagccaggtctcatctgacacgttttcttttcctgcccccacaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatac

SEQ ID NO: 435292 - DNA, 1083 bp, Homo sapiens
ggcggctgcgcgcggaggcggtggaggaggtgctgggagcagccgggcagccgcttcccgcccccgagcaggagccggtgcgagcggagcagagccgaggtcgggccgcgagcggagccggctgagcgggcgccgagctcccgccatggcccggaacacgctgtcctcgcgcttccgccgggtggacatcgacgaatttgacgagaacaaatttgtggacgagcaggaggaggcggcggcggcggcggcggagccaggcccggacccgagcgaggtggacgggctcctgcggcaaggggacatgcttcgggcattccatgcagccttgcggaactctcccgtcaacaccaagaatcaagctgtgaaggagcgagcccagggcgtggtgctgaaagtgctcacaaacttcaagagcagtgagattgagcaggctgtgcagtcactggacagaaacggcgttgacttgttaatgaagtacatttataaaggctttgagaagcccacagaaaatagcagcgcagtgttactccagtggcacgaaaaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatac

SEQ ID NO: 435293 - DNA, 2286 bp, Homo sapiens
  misc_feature (1097)..(1097): n is a, c, g, or t
ctaggtaggaagggggcctgctggttggttggggcttcatgatacttgcagtggtggaggcagctgttgggggttcttagaaatagagtcctccagccagctctaagggcttcctgccctggcctcagccttagcaggccagagtgagcagtgggcagaaaccttgacctcacttaatatggccttcgtccaggtgaagcagaaagagctgtgtctgcccttcgcttgggtccgtgtgagagcaaggcctttggcaagcctgtgtcgtgcctgtaccactggggctgcctcccacaccctcccctgcacacccctagtgccgcagtaagcacgcccaccattaaagcagaccaggagttactaacctgcctgccttcctcagaggctcagtgttgagttggaagagaggggttttacagtgggccagtccttaaggtggtgtgggtgctgggctgtggttgtggccttaggtctgctggcgggtgtgctgcacctccttggcctcccctctcctgggctcaaggaagtaaacaagtcctctgtatgatggggaggccaggacctctcgtccctttaaggcagcttggtgcctgccagtcacctcagcgggcggcagtcagtgggcttgtgtgcatctgtaaactcagcactttgggaggctgaggcaggaggattgctggagcccaggagttcaagaacagcccaggcaatgtagtgagaacccatctctacaaaaaaataaactaggctgggtgcggtgggctcacgcctgtaatcccagcattttgggagacggaggcaggcggatgacctgaggtcaggagctcaagaccagcctgggcaacatggtgaaaccccgtctctactaaaaatacaaaaattagccgggggtggtggcgggcgcctgtaatcccagctgctcgggaggctgaggcaggagaagcgcttgaactggggaggcagggttgcagtgagccgagatcgtgccattgcactccagcctgggtgacaagagcgaaactccgtctcaaaaaaaataaattagccgggcctggtggtgcacacctgtggtcccagctactcaggaggatggcttnaacccaggacatcaaggctgtgcagtgagctgtgatctgggcaacagagtgagaccccatctcaaaagggaagctcgagggctctgctttgtgtgctggtgacagtgttctcaagccagttctgcccaagagccaacagctctcgggaccccacggctccaggacagggctccttccctagaatgtgctctatctcaggaatcctctttcgaggatctgtgacgggatctaggtcagggaatgtcccccctgtctctggcaagccaggctccccttggccagccaggtctcatctgacacgttttcttttcctgcccccacaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatacattgcggtgtgtttcgtgtatgtaaaaaaaaatggtaatgaatgggatggtaatgaatgagagttcagttgttgttccggaaacccgatgtggaaggagtagacctgtgtccctgttgagccacccctgggagcgagcatggcaatccacaggccctctgccacaggacgccagcctcggcctcagagctgccggctgctgcagagaggtgtttgctgaataaactatttattgtttcttattcctttgatttgtatgtaattaattttggagcttatttaattaatttaataaagtgccaaacatttaataattgaaaaaaaaaaa

SEQ ID NO: 435294 - DNA, 1410 bp, Homo sapiens
ggcggctgcgcgcggaggcggtggaggaggtgctgggagcagccgggcagccgcttcccgcccccgagcaggagccggtgcgagcggagcagagccgaggtcgggccgcgagcggagccggctgagcgggcgccgagctcccgccatggcccggaacacgctgtcctcgcgcttccgccgggtggacatcgacgaatttgacgagaacaaatttgtggacgagcaggaggaggcggcggcggcggcggcggagccaggcccggacccgagcgaggtggacgggctcctgcggcaaggggacatgcttcgggcattccatgcagccttgcggaactctcccgtcaacaccaagaatcaagctgtgaaggagcgagcccagggcgtggtgctgaaagtgctcacaaacttcaagagcagtgagattgagcaggctgtgcagtcactggacagaaacggcgttgacttgttaatgaagtacatttataaaggctttgagaagcccacagaaaatagcagcgcagtgttactccagtggcacgaaaaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatacattgcggtgtgtttcgtgtatgtaaaaaaaaatggtaatgaatgggatggtaatgaatgagagttcagttgttgttccggaaacccgatgtggaaggagtagacctgtgtccctgttgagccacccctgggagcgagcatggcaatccacaggccctctgccacaggacgccagcctcggcctcagagctgccggctgctgcagagaggtgtttgctgaataaactatttattgtttcttattcctttgatttgtatgtaattaattttggagcttatttaattaatttaataaagtgccaaacatttaataattgaaaaaaaaaaa

SEQ ID NO: 435295 - DNA, 1084 bp, Homo sapiens
ggcggctgcgcgcggaggcggtggaggaggtgctgggagcagccgggcagccgcttcccgcccccgagcaggagccggtgcgagcggagcagagccgaggtcgggccgcgagcggagccggctgagcgggcgccgagctcccgccatggcccggaacacgctgtcctcgcgcttccgccgggtggacatcgacgaatttgacgagaacaaatttgtggacgagcaggaggaggcggcggcggcggcggcggagccaggcccggacccgagcgaggtggacgggctcctgcggcaaggggacatgcttcgggcattccatgcagccttgcggaactctcccgtcaacaccaagaatcaagctgtgaaggagcgagcccagggcgtggtgctgaaagtgctcacaaacttcaagagcagtgagattgagcaggctgtgcagtcactggacagaaacggcgttgacttgttaatgaagtacatttataaaggctttgagaagcccacagaaaatagcagcgcagtgttactccagtggcacgaaaaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtcacaaattcttgacctccttcacagtaactgctctaactctttgccctcgcgtataactaagaatctt

SEQ ID NO: 435296 - DNA, 920 bp, Homo sapiens
gaagccgtggaaggtgggtggtatggatgagatcccatctgactctgttcctgagctgtttctgaagtgagcttgttcatgacggcatggatgtgcttgagcctagctatccttaactggtggtgatgcacaggggacatgcttcgggcattccatgcagccttgcggaactctcccgtcaacaccaagaatcaagctgtgaaggagcgagcccagggcgtggtgctgaaagtgctcacaaacttcaagagcagtgagattgagcaggctgtgcagtcactggacagaaacggcgttgacttgttaatgaagtacatttataaaggctttgagaagcccacagaaaatagcagcgcagtgttactccagtggcacgaaaaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatac

SEQ ID NO: 435297 - DNA, 1379 bp, Homo sapiens
ggcggctgcgcgcggaggcggtggaggaggtgctgggagcagccgggcagccgcttcccgcccccgagcaggagccggtgcgagcggagcagagccgaggtcgggccgcgagcggagccggctgagcgggcgccgagctcccgccatggcccggaacacgctgtcctcgcgcttccgccgggtggacatcgacgaatttgacgagaacaaatttgtggacgagcaggaggaggcggcggcggcggcggcggagccaggcccggacccgagcgaggtggacgggctcctgcggcaaggggacatgcttcgggcattccatgcagccttgcggaactctcccgtcaacaccaagaatcaagctgtgaaggagcgagcccagggcgtggtgctgaaagtgctcacaaacttcaagagcagtgagattgagcaggctgtgcagtcactggacagaaacggcgttgacttgttaatgaagtacatttataaaggctttgagaagcccacagaaaatagcagcgcagtgttactccagtggcacgaaaaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatacattgcggtgtgtttcgtgtatgtaaaaaaaaatggtaatgaatgggatggtaatgaatgagagttcagttgttgttccggaaacccgatgtggaaggagtagacctgtgtccctgttgagccacccctgggagcgagcatggcaatccacaggccctctgccacaggacgccagcctcggcctcagagctgccggctgctgcagagaggtgtttgctgaataaactatttattgtttcttattcctttgatttgtatgtaattaattttggagcttatttaattaatttaataaagtgccaaacatttaataattgaaaaaaaaaaa

SEQ ID NO: 435298 - DNA, 1029 bp, Homo sapiens
ggcggctgcgcgcggaggcggtggaggaggtgctgggagcagccgggcagccgcttcccgcccccgagcaggagccggtgcgagcggagcagagccgaggtcgggccgcgagcggagccggctgagcgggcgccgagctcccgccatggcccggaacacgctgtcctcgcgcttccgccgggtggacatcgacgaatttgacgagaacaaatttgtggacgagcaggaggaggcggcggcggcggcggcggagccaggcccggacccgagcgaggtggacgggctcctgcggcaaggggacatgcttcgggcattccatgcagccttgcggaactctcccgtcaacaccaagaatcaagctgtgaaggagcgagcccagggcgtggtgctgaaagtgctcacaaacttcaagagcagtgagattgagcaggctgtgcagtcactggacagaaacggcgttgacttgttaatgaagtacatttataaaggctttgagaagcccacagaaaatagcagcgcagtgttactccagtggcacgaaaaggccttagcagtaggaggactaggctccattataagagttcttacagcaagaaagactgtttaaaaaaaataggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatac

SEQ ID NO: 435299 - DNA, 4447 bp, Homo sapiens
gtcggaggtgaggagacgtcgccgggtgaggaagcggggggctagcggcctggcgctgcggcgaccgaccggggcgtcaggatccctggcccccggagagcgaagggcgggcgggtcccggagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacggtattataaagctgtggaagttttttccactagtttcaggtgttttttttttttgttgttgttgttgttattttgaactacttaccaaaattagaagttaaaatctaattagaaattaataagatactaaaattcatgacagttttttgtttgtttgtttgtttgttttttggtatttcttgatttgggcataaaaggcacacccattctctcatgcttggaagaagctgctattcctactggctatctaagaagaatggaattattaattttatttgacttattaattttaaacgagtttaatttgggatcatttagtaagtactcttttctttttgagctgtgatagattatagtctagtttaagttgctcctaagtagacagatgaagaaactagggaggctttagagaggaagacagatgcttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtagctcaagcctgtaatcccagcactttgggaggccaggcaggaggattgcttgaggccaggagtttgagaccagcctgggcaacatagtaagacctcatctctacaaaaaataaaaaattatccaggtgtgggccgacagtcccagctactagggaggctaaggcagggtgattgattgagcccagtagtttgaggctgcagtgagttatgattgcgccactacactcccacttgggcaacagacaagagatcttatctctaaaaaatttttgttaaataataaaagaattaaggccagggatgttggctcacatctgtaatcccagcagggattatagtctcgggaggctgaggtgggcggattgcttgagcccggaaggtcaagaccagcctgggtgccatggtgaaaccccatctctacaaaaaaatacaaaaactagctgggtgtggtggcaccacctgtagtccccgctacttaggaggctgaggtgggaggattgcttgagcccaggaggcagaaggttgcagaggttgcagtgagccttgattgtgccactgtactccagtctgggcaacagggcaagaccctgtctc

SEQ ID NO: 435300 - DNA, 1796 bp, Homo sapiens
atgatgcctctgggatttatgaaaccaacctttgtggcgagtgctcagtgattctgatgcaatggtggtattccacactgtgagaaacactaagagaagaggtaagatagaatgagggaataaacatggcttgtttattattttgggggatttaccaataactggtttaattctgttcatgatccaatagtattggtgatattagctccattttatagatgaggaactcatgtttagatctgaaataaggtatgtgagagtccatatctcttttcagctaaacttgtgagactttcgtaaagaagcgtttgtatttatttatttgtttttgagacagggtcttgctcttttgcccaggctggagtgcagtggcatgatatggctcactgcagccttgacttcctgggctcaagggatccttctgcctcagcctcctgagtagctgggactacaggtatgtaccaccatgcccagctaatttttgtatctttttgtagagactacattttgccatgttgtccaggctggtcttgaactcctgagctcaagcatctgcccacctcagcttcccaaagtgctgggattacaggtgtgagccactgtgcccagctgagagtttttcttgtcgtgaaagaacttgacatttcctcaaggatttataaaggaggctgaggagtaattttcccaggagaattttaaaaagaaagcgggcattgctcctccagtggtttggaatgatgccacttgattgtgcaaatgatttcttatgatcttgtctggttttctgttattttttgatttggtgacatagctctcaaagatttggtgacacagcttcttgagtcactttcatctctcttaaaaaaaatttttttttaacaacttttaagttcaggggtacatgtgccagtttgtttcataggtaaacttacgtcatgggggtttgttgtatagatgatttcatcacccaggtgttaagcctagtacccattagtaatttttcctgatcctctccctcctcctaccctccaccctccaatagaccccagtgtgtgttgttgccctttatgtgtccatgtgttctcatcatttagctctcacttatcagtgagaacaactttcatcccacatctaatttgtctttcttcactctggtgtggaaattttgatagagattccaatatcacttaaacgtttcccagaatatttagatagaataatttagtttcttctgaaaagtttattttaggctagtgccacatggttgtgaatattagcatggtagccaaataatagtttgtttaaatgtatatttcccaatataaatataaggggcatcataatttttaaaaactataaaatctagaagaaaaatctatggataaaatccataattctatcatctgaatgcaatgaacattagcatttaggtatattttcttgcaggttttttaaccatatacttatagagaatatgtaatttgggtctgtgttttttacatataaatatttttctatgttaaatagtcttcataagttaattataaagatctgcttaatagttctgctactgcagttttcattattagataagttggtcattatagttggacatttaggtttacaatattaaagcagtggtttatatcaatttcagtggtttaaaatatgaatttctattttggaatgaaagtattaatttaatgtagtgaatctcatattccagaactgagatgattgatttgatgctatttgtgacagacagaacccataataaagcctttctatgcaagtta

SEQ ID NO: 435301 - DNA, 1271 bp, Homo sapiens
tttattgttttcactttccatgtgattagattgaggctaaatattttggcaggaaaattatagaagaagttttcctgcaaatatttttacaggaaattatgtttttgtaagaaaattattattgtacaataataattatataattattataactatagacaagtaaattgtatatttttttcttaccataaaagtctaaactcatgaaagtagtttatatgtgctctcttaaaaatcactttatttaagctatgaaatttgattatgctgtaatgtggccaggcctgtacacttccttcattacttgttttttgtctgtctccatgtcagctccatgaagaaggagatgctgtgtgttttgcttactgtagtagccctggattctaggacagtacctggcttaagaagcttaagaattatttgttgaataaacagttttttctgaaattgatgaaataataaaaaatgactgcacattcccatatcaagaatttgagaagttaacattttatgtttttgtttttggtctaagtacaagagacctagttttattgtgactcagtttctggaatagttgccccggatttcgagtgcttttctccttacctccaccctcccccatgttttaatgcagccctccaaaaatatttactgagtgtggactctagaccagggcctgtgctaggatacaaagatgaatgaggcaccacccttatcttcgagtagtatatgttttattttattttatttttttcccctgctgcctcccttgagtagtacatgttttagtaaggggaacagacactaaagagtcctggtaatgatgagcaaagtactgcatgagtaagtatctggggggcaagtgtccccactaggactcctgtcagatctggaaaaggcctgaggaatctgatacatgacttaatgcagcgtatacttgcagcctgaaaactaagtaatgacaaaatagacattcttgtcagtgtgagccattctctgagtccaaggggagtacataattcaaaccagaattggtcattttggagtttgcactcttagcagtatacagtggagtgaaatttaagaatcaatttaatttcttttcagtttttatgtacataaaacctgcttactacaagagacccagtttattattttgtgttggttaacattcataagtatatttcatcataataaggctccgtgaaattagtcattttatcatttgccaataaagacatatatctgaaaataaatgttcctgaacctga

SEQ ID NO: 435302 - DNA, 1232 bp, Homo sapiens
atgatgcctctgggatttatgaaaccaacctttgtggcgagtgctcagtgattctgatgcaatggtggtattccacactgtgagaaacactaagagaagaggtaagatagaatgagggaataaacatggcttgtttattattttgggggatttaccaataactggtttaattctgttcatgatccaatagtattggtgatattagctccattttatagatgaggaactcatgtttagatctgaaataaggtatgtgagagtccatatctcttttcagctaaacttgtgagactttcgtaaagaagcgtttgtatttatttatttgtttttgagacagggtcttgctcttttgcccaggctggagtgcagtggcatgatatggctcactgcagccttgacttcctgggctcaagggatccttctgcctcagcctcctgagtagctgggactacaggtatgtaccaccatgcccagctaatttttgtatctttttgtagagactacattttgccatgttgtccaggctggtcttgaactcctgagctcaagcatctgcccacctcagcttcccaaagtgctgggattacaggtgtgagccactgtgcccagctgagagtttttcttgtcgtgaaagaacttgacatttcctcaaggatttataaaggaggctgaggagtaattttcccaggagaattttaaaaagaaagcgggcattgctcctccagtggtttggaatgatgccacttgattgtgcaaatgatttcttatgatcttgtctggttttctgttattttttgatttggtgacatagctctcaaagatttggtgacacagcttcttgagtcactttcatctctcttaaaaaaaatttttttttaacaacttttaagttcaggggtacatgtgccagtttgtttcataggtaaacttacgtcatgggggtttgttgtatagatgatttcatcacccaggtgttaagcctagtacccattagtaattttctgatcttcctctctacctcactcaatagaccaatgtggttgtgccttatggtcagtgtcttattattaggctcatatcgtggaacattttcccattatggctctcactggtgtgattgttcagatcaattcttacgtcccaatagaaaaatggtcgaaattaggacgccggggatattgggccactgtggtttccacagggtaaacaacagacactcgaccttttccctc

SEQ ID NO: 435303 - DNA, 827 bp, Homo sapiens
  misc_feature (803)..(803): n is a, c, g, or t
  misc_feature (815)..(815): n is a, c, g, or t
atgatgcctctgggatttatgaaaccaacctttgtggcgagtgctcagtgattctgatgcaatggtggtattccacactgtgagaaacactaagagaagaggtaagatagaatgagggaataaacatggcttgtttattattttgggggatttaccaataactggtttaattctgttcatgatccaatagtattggtgatattagctccattttatagatgaggaactcatgtttagatctgaaataaggtatgtgagagtccatatctcttttcagctaaacttgtgagactttcgtaaagaagcgtttgtatttatttatttgtttttgagacagggtcttgctcttttgcccaggctggagtgcagtggcatgatatggctcactgcagccttgacttcctgggctcaagggatccttctgcctcagcctcctgagtagctgggactacaggtatgtaccaccatgcccagctaatttttgtatctttttgtagagactacattttgccatgttgtccaggctggtcttgaactcctgagctcaagcatctgcccacctcagcttcccaaagtgctgggattacaggtgtgagccactgtgcccagctgagagtttttcttgtcgtgaaagaacttgacatttcctcaaggatttataaaggaggctgaggagtaattttcccaggagaattttaaaaagaaagcgggcattgctcctccagtggtttggaatgatgccacttgattgtgcaaatgatttcttatgatcttgtctggttttctgttataactctgcagangtgtgagctganacagtctgactt

SEQ ID NO: 435304 - DNA, 4614 bp, Homo sapiens
gtcggaggtgaggagacgtcgccgggtgaggaagcggggggctagcggcctggcgctgcggcgaccgaccggggcgtcaggatccctggcccccggagagcgaagggcgggcgggtcccggaggcaccttcactaacccggtgcggagcacttggcgacgcctccctgcccatctcatatctctcggctcatcgctgctctgggcaccagctgcctcttggctggcgctgctgtcacacggtggactgttctggccttactgagctgccgtttggggacatcagattcagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacggtattataaagctgtggaagttttttccactagtttcaggtgttttttttttttgttgttgttgttgttattttgaactacttaccaaaattagaagttaaaatctaattagaaattaataagatactaaaattcatgacagttttttgtttgtttgtttgtttgttttttggtatttcttgatttgggcataaaaggcacacccattctctcatgcttggaagaagctgctattcctactggctatctaagaagaatggaattattaattttatttgacttattaattttaaacgagtttaatttgggatcatttagtaagtactcttttctttttgagctgtgatagattatagtctagtttaagttgctcctaagtagacagatgaagaaactagggaggctttagagaggaagacagatgcttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtagctcaagcctgtaatcccagcactttgggaggccaggcaggaggattgcttgaggccaggagtttgagaccagcctgggcaacatagtaagacctcatctctacaaaaaataaaaaattatccaggtgtgggccgacagtcccagctactagggaggctaaggcagggtgattgattgagcccagtagtttgaggctgcagtgagttatgattgcgccactacactcccacttgggcaacagacaagagatcttatctctaaaaaatttttgttaaataataaaagaattaaggccagggatgttggctcacatctgtaatcccagcagggattatagtctcgggaggctgaggtgggcggattgcttgagcccggaaggtcaagaccagcctgggtgccatggtgaaaccccatctctacaaaaaaatacaaaaactagctgggtgtggtggcaccacctgtagtccccgctacttaggaggctgaggtgggaggattgcttgagcccaggaggcagaaggttgcagaggttgcagtgagccttgattgtgccactgtactccagtctgggcaacagggcaagaccctgtctc

SEQ ID NO: 435305 - DNA, 4648 bp, Homo sapiens
gtcggaggtgaggagacgtcgccgggtgaggaagcggggggctagcggcctggcgctgcggcgaccgaccggggcgtcaggatccctggcccccggagagcgaagggcgggcgggtcccggaggcaccttcactaacccggtgcggagcacttggcgacgcctccctgcccatctcatatctctcggctcatcgctgctctgggcaccagctgcctcttggctggcgctgctgtcacacggtggactgttctggccttactgagctgccgtttggggacatcagattcaggtcgtatggggagaaacgagtgtaactttacaagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacggtattataaagctgtggaagttttttccactagtttcaggtgttttttttttttgttgttgttgttgttattttgaactacttaccaaaattagaagttaaaatctaattagaaattaataagatactaaaattcatgacagttttttgtttgtttgtttgtttgttttttggtatttcttgatttgggcataaaaggcacacccattctctcatgcttggaagaagctgctattcctactggctatctaagaagaatggaattattaattttatttgacttattaattttaaacgagtttaatttgggatcatttagtaagtactcttttctttttgagctgtgatagattatagtctagtttaagttgctcctaagtagacagatgaagaaactagggaggctttagagaggaagacagatgcttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtagctcaagcctgtaatcccagcactttgggaggccaggcaggaggattgcttgaggccaggagtttgagaccagcctgggcaacatagtaagacctcatctctacaaaaaataaaaaattatccaggtgtgggccgacagtcccagctactagggaggctaaggcagggtgattgattgagcccagtagtttgaggctgcagtgagttatgattgcgccactacactcccacttgggcaacagacaagagatcttatctctaaaaaatttttgttaaataataaaagaattaaggccagggatgttggctcacatctgtaatcccagcagggattatagtctcgggaggctgaggtgggcggattgcttgagcccggaaggtcaagaccagcctgggtgccatggtgaaaccccatctctacaaaaaaatacaaaaactagctgggtgtggtggcaccacctgtagtccccgctacttaggaggctgaggtgggaggattgcttgagcccaggaggcagaaggttgcagaggttgcagtgagccttgattgtgccactgtactccagtctgggcaacagggcaagaccctgtctc

SEQ ID NO: 435306 - DNA, 3800 bp, Homo sapiens
ccatcttgcactcccagagtattgggattacagacatgagccactgcacctgcccagctccccaactccctgccattttttaagagacggtttcgtttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggctcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccattatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacggccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacggtattataaagctgtggaagttttttccactagtttcaggtgttttttttttttgttgttgttgttgttattttgaactacttaccaaaattagaagttaaaatctaattagaaattaataagatactaaaattcatgacagttttttgtttgtttgtttgtttgttttttggtatttcttgatttgggcataaaaggcacacccattctctcatgcttggaagaagctgctattcctactggctatctaagaagaatggaattattaattttatttgacttattaattttaaacgagtttaatttgggatcatttagtaagtactcttttctttttgagctgtgatagattatagtctagtttaagttgctcctaagtagacagatgaagaaactagggaggctttagagaggaagacagatgcttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtagctcaagcctgtaatcccagcactttgggaggccaggcaggaggattgcttgaggccaggagtttgagaccagcctgggcaacatagtaagacctcatctctacaaaaaataaaaaattatccaggtgtgggccgacagtcccagctactagggaggctaaggcagggtgattgattgagcccagtagtttgaggctgcagtgagttatgattgcgccactacactcccacttgggcaacagacaagagatcttatctctaaaaaatttttgttaaataataaaagaattaaggccagggatgttggctcacatctgtaatcccagcagggattatagtctcgggaggctgaggtgggcggattgcttgagcccggaaggtcaagaccagcctgggtgccatggtgaaaccccatctctacaaaaaaatacaaaaactagctgggtgtggtggcaccacctgtagtccccgctacttaggaggctgaggtgggaggattgcttgagcccaggaggcagaaggttgcagaggttgcagtgagccttgattgtgccactgtactccagtctgggcaacagggcaagaccctgtctc

SEQ ID NO: 435307 - DNA, 2409 bp, Homo sapiens
gtcggaggtgaggagacgtcgccgggtgaggaagcggggggctagcggcctggcgctgcggcgaccgaccggggcgtcaggatccctggcccccggagagcgaagggcgggcgggtcccggagcaagaagaattgtatagaaatgtaaaaaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatccgtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagctccatgaagaaggagatgctgtgtgttttgcttactgtagtagccctggattctaggacagtacctggcttaagaagcttaagaattatttgttgaataaacagttttttctgaaattgatgaaataataaaaaatgactgcacattcccatatcaagaatttgagaagttaacattttatgtttttgtttttggtctaagtacaagagacctagttttattgtgactcagtttctggaatagttgccccggatttcgagtgcttttctccttacctccaccctcccccatgttttaatgcagccctccaaaaatatttactgagtgtggactctagaccagggcctgtgctaggatacaaagatgaatgaggcaccacccttatcttcgagtagtatatgttttattttattttatttttttcccctgctgcctcccttgagtagtacatgttttagtaaggggaacagacactaaagagtcctggtaatgatgagcaaagtactgcatgagtaagtatctggggggcaagtgtccccactaggactcctgtcagatctggaaaaggcctgaggaatctgatacatgacttaatgcagcgtatacttgcagcctgaaaactaagtaatgacaaaatagacattcttgtcagtgtgagccattctctgagtccaaggggagtacataattcaaaccagaattggtcattttggagtttgcactcttagcagtatacagtggagtgaaatttaagaatcaatttaatttcttttcagtttttatgtacataaaacctgcttactacaagagacccagtttattattttgtgttggttaacattcataagtatatttcatcataataaggctccgtgaaattagtcattttatcatttgccaataaagacatatatctgaaaataaatgttcctgaacctga

SEQ ID NO: 435308 - DNA, 4532 bp, Homo sapiens
taccagtttgaatacatggcccagcacctggtgtttgccaactgcattcctttgatcctaaagttcttcaatcaaaacatcatgtcctacatcactgccaagaacagcattttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattaaaaaaaaaatgcctatgcaacttcaaatagtctgatgcctgcttccccaggacgagtgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggttacatttgctttccgtgaaatgctcagaaaatgtcaggacattccttttccaattgtgtgtcagtgcgtattgtaataaaactactgatttaaatta

SEQ ID NO: 435309 - DNA, 942 bp, Homo sapiens
  misc_feature (771)..(771): n is a, c, g, or t
  misc_feature (783)..(783): n is a, c, g, or t
aatagacactatattaattatatcaaatatgcggcagtagcaaaaattataatctaattcatgcattttatataacatgtatatcctgcgtactaagtactacagccacagagtgagccatgaaatggatggacttatttttcagcctactggaaaatacaaacctggtcgatgtgatgatattttgaaatggaagcctcccagtctgaattctgtggattttcgtctaaaaataacaagaatgggaggagaaggaacctcagaggatccagaacggcagctggtccttgctggactgttcctgtccatgtgcctggtcatggtgctggggaacctgctcatcatccggccatgagccctgactcccacctccacacctccatgtacttcttcctctccaacctgtccttgcctgacatcggtttcacctccaccacggtcccccagatgactgtggacatccagtctcgcagcagagtcatctcctatgcaggctgcctgactcagaagtctctctttgccatttttggaggcacggaagagagacatgctcctgagtgtgatggcctatgaccggtttgtagccatctgtcaccctctatatcattcagccatcatgaacctgtgtttctgtggcttcctagttttgctgtcttttttttttctcagtcttttagactcccagctgtacaacttgattgccttactaatgacctgcttcaaggaggtggacattcctaatttcttctgtgacctttctcaactcccccntcttgccgttgngacaccttcatcaataacataatcatgtatttccctactgccatatttgggttttcttcccacctcgggagacccctttcctctttactattaaaatcgctccctccattgctgagggtttcatccttcagggggggaagtataaagaccctcttcccc

SEQ ID NO: 435310 - DNA, 868 bp, Homo sapiens
  misc_feature (697)..(697): n is a, c, g, or t
  misc_feature (709)..(709): n is a, c, g, or t
atatatttatctgataatttagtgaagtttaacataagcggccagaaccccggccttctgtataagtgctgctctgattcaaatacaaacctggtcgatgtgatgatattttgaaatggaagcctcccagtctgaattctgtggattttcgtctaaaaataacaagaatgggaggagaaggaacctcagaggatccagaacggcagctggtccttgctggactgttcctgtccatgtgcctggtcatggtgctggggaacctgctcatcatccggccatgagccctgactcccacctccacacctccatgtacttcttcctctccaacctgtccttgcctgacatcggtttcacctccaccacggtcccccagatgactgtggacatccagtctcgcagcagagtcatctcctatgcaggctgcctgactcagaagtctctctttgccatttttggaggcacggaagagagacatgctcctgagtgtgatggcctatgaccggtttgtagccatctgtcaccctctatatcattcagccatcatgaacctgtgtttctgtggcttcctagttttgctgtcttttttttttctcagtcttttagactcccagctgtacaacttgattgccttactaatgacctgcttcaaggaggtggacattcctaatttcttctgtgacctttctcaactcccccntcttgccgttgngacaccttcatcaataacataatcatgtatttccctactgccatatttgggttttcttcccacctcgggagacccctttcctctttactattaaaatcgctccctccattgctgagggtttcatccttcagggggggaagtataaagaccctcttcccc

SEQ ID NO: 435311 - DNA, 4461 bp, Homo sapiens
gaagttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattaaaaaaaaaatgcctatgcaacttcaaatagtctgatgcctgcttccccaggacgagtgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggttacatttgctttccgtgaaatgctcagaaaatgtcaggacattccttttccaattgtgtgtcagtgcgtattgtaataaaactactgatttaaatta

SEQ ID NO: 435312 - DNA, 4403 bp, Homo sapiens
gaagttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggttacatttgctttccgtgaaatgctcagaaaatgtcaggacattccttttccaattgtgtgtcagtgcgtattgtaataaaactactgatttaaatta

SEQ ID NO: 435313 - DNA, 4441 bp, Homo sapiens
gaagttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattaaaaaaaaaatgcctatgcaacttcaaatagtctgatgcctgcttccccaggacgagtgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggttacatttgctttccgtgaaatgctcagaaaatgtcaggacattccttttccaattgtgtgtcagtgcgtattgtaataaaactactgatttaaatta

SEQ ID NO: 435314 - DNA, 4911 bp, Homo sapiens
gaagttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattaaaaaaaaaatgcctatgcaacttcaaatagtctgatgcctgcttccccaggacgagtgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggttacatttgctttccgtgaaatgctcagaaaatgtcaggacattccttttccaattgtgtgtcagtgcgtattgtaataaaactactgatttaaattaaaaaaaaaaaaaaaaaaaaaaaaaaaaaaaaaaaaaaaaaaaaaaaaaaaaaaaaacaaaaacaaaaacaataaaacaaaaaaaaaaagaagggggggggccccagtaacacactcccgcctcaggggggacgaacacaggtacggcagcacacagtgtatgtctgtgaacaacacggcggccccacaaaagaggagacagcacgtatttaacacaaccagccggcggcgcggcgcgcgaacactaaacaaacaccgcggggagagagcagacacataacgactacggactgagcggctcatctagtggaagcgcaagaacccctcaatcaccccggcaggcggaggagcaacaaacagcgtagcggacaacacctaggcagccaaagcaggacacctcacgtcgcgccgggaggaacccaatataacaagccacgagacgcacacccgg

SEQ ID NO: 435315 - DNA, 4392 bp, Homo sapiens
gaagttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattaaaaaaaaaatgcctatgcaacttcaaatagtctgatgcctgcttccccaggacgagtgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggttacatttgctttccgtgaaatgctcagaaaatgtcaggacattccttttccaattgtgtgtcagtgcgtattgtaataaaactactgatttaaatta

SEQ ID NO: 435316 - DNA, 4937 bp, Homo sapiens
gaagttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattaaaaaaaaaatgcctatgcaacttcaaatagtctgatgcctgcttccccaggacgagtgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggttacatttgctttccgtgaaatgctcagaaaatgtcaggacattccttttccaattgtgtgtcagtgcgtattgtaataaaactactgatttaaattagcataagtgtatctactttgttttactggtgatactcttgtgtcccttctattgctggcatcacatcctactgctgtcagccacacccagtgtaatccatctggctttgtagagattagcataaagacttggaaagcctctatttttctttctgagaaactgagaaatttgattgacacaggggggtgtagtttgaaccttttatttttgaagtggagaggaatgggagaaagcacatctttatatgatgtttatattatttctcttcatctaatcttagcagtctactgtatgagtagatattctgttacattatttttaatgcatttaaattttttagaatactcagcaatagcaataaatattctgaaatgatgaagtcgtgaactaccaaatttttttttgcattgcatttttatagtatggaatttgccatctttaaatgtttaaataataccaccattttgaactctgca

SEQ ID NO: 435317 - DNA, 2443 bp, Homo sapiens
  misc_feature (1775)..(1775): n is a, c, g, or t
gaagttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtatgtttgttcattttcagtgtacttttcctggatgttctcttatctngaatccatcaaaaccttgctaataataatcaacatataaaaatatcgtgttccagcactttgggaggctaagacaggtggatcacttgagcccaggaggttgagaccatgctgggaaccctgtctctacaaaaagaaaaattttttgtcattagccaagttcagtggcatgtgcctatagtcccagctactctggaggctgaggtgggaagatcacttaagccccatgagtttgaggctgcagtgagccgtgatcacaccactgtactccagcctgggtgacagagtgagaccctgtctcaaaaaaaaaaaaaaaaaaaaaaagtgaatgtgaggtgataatttcataagcttttgcatatttctgctgaagaaatctttcagcttttcaaaggaattgattattttaatattcttgccatagtaaaattgactttgaccgaaacagttcagtgattcatttagaagagtacatttagagattaatctttgagatcatcccttttgccattaaaaaaatgtttacaagtcgggtacggtggctcatgcctgcactaccagtgctttttgaggccgaggtgggagggtcagggctggaagattgcttgggcccagaagttcgagactagcctgggcaacatagtgaaacctcatctctacaaaatagta

SEQ ID NO: 435318 - DNA, 2346 bp, Homo sapiens
  misc_feature (2175)..(2175): n is a, c, g, or t
  misc_feature (2187)..(2187): n is a, c, g, or t
gaagttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaaggaacctcagaggatccagaacggcagctggtccttgctggactgttcctgtccatgtgcctggtcatggtgctggggaacctgctcatcatccggccatgagccctgactcccacctccacacctccatgtacttcttcctctccaacctgtccttgcctgacatcggtttcacctccaccacggtcccccagatgactgtggacatccagtctcgcagcagagtcatctcctatgcaggctgcctgactcagaagtctctctttgccatttttggaggcacggaagagagacatgctcctgagtgtgatggcctatgaccggtttgtagccatctgtcaccctctatatcattcagccatcatgaacctgtgtttctgtggcttcctagttttgctgtcttttttttttctcagtcttttagactcccagctgtacaacttgattgccttactaatgacctgcttcaaggaggtggacattcctaatttcttctgtgacctttctcaactcccccntcttgccgttgngacaccttcatcaataacataatcatgtatttccctactgccatatttgggttttcttcccacctcgggagacccctttcctctttactattaaaatcgctccctccattgctgagggtttcatccttcagggggggaagtataaagaccctcttcccc

SEQ ID NO: 435319 - DNA, 2439 bp, Homo sapiens
  misc_feature (2268)..(2268): n is a, c, g, or t
  misc_feature (2280)..(2280): n is a, c, g, or t
gaagttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaatacggggttttgccttgttgccgaggctggtctaaagctcctgagctcaagcaatccgcctgcctcagcctcgcaaagtgctgggattacagaaatacaaacctggtcgatgtgatgatattttgaaatggaagcctcccagtctgaattctgtggattttcgtctaaaaataacaagaatgggaggagaaggaacctcagaggatccagaacggcagctggtccttgctggactgttcctgtccatgtgcctggtcatggtgctggggaacctgctcatcatccggccatgagccctgactcccacctccacacctccatgtacttcttcctctccaacctgtccttgcctgacatcggtttcacctccaccacggtcccccagatgactgtggacatccagtctcgcagcagagtcatctcctatgcaggctgcctgactcagaagtctctctttgccatttttggaggcacggaagagagacatgctcctgagtgtgatggcctatgaccggtttgtagccatctgtcaccctctatatcattcagccatcatgaacctgtgtttctgtggcttcctagttttgctgtcttttttttttctcagtcttttagactcccagctgtacaacttgattgccttactaatgacctgcttcaaggaggtggacattcctaatttcttctgtgacctttctcaactcccccntcttgccgttgngacaccttcatcaataacataatcatgtatttccctactgccatatttgggttttcttcccacctcgggagacccctttcctctttactattaaaatcgctccctccattgctgagggtttcatccttcagggggggaagtataaagaccctcttcccc

SEQ ID NO: 435320 - DNA, 379 bp, Homo sapiens
agcaatttatttttagaatttcagaattttctgaataccttatattaaaaccttttcagaatgaatgtgtcccttaatagattgaatgacttgagggtgaggattgtgatttgcccattttataaacttctgttgtactttatatggagccttgaatataataagtgagtttttgataagcctgcataaatagaggatagcgaggaaattgcatggtgtttgtttcctatagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatga

SEQ ID NO: 435321 - DNA, 505 bp, Homo sapiens
cagaccagagtgcagtggtgtaatctctgctcactgcagcctctacctcccgggttcaagcgattctcctgtctcagcctcccaagtagctgggactacaggcgtatgcacacacacccggctaattgtgtatttttagtagtgacggggtttcaccatgttaaccaggctggtctcaaactcctgacctcaggtgatccacccgcctcagtgagccactgtgcccggccaaaaagattttttagattgggatataactagtattcagtaaagtgcacacgtcttaattataaggcttcatgaattattatattcatatacacccatgtatctacctccctcatacccccatcaagatacagaacatttccagcatcgtagaaggctgtctccttcatgccccctttccagtcaatgtcttcttccaggagaaatcattatttttaacctttatcaccatagatttgtgcctgtatttgaacatcatataaatggaatcatacag

SEQ ID NO: 435322 - DNA, 781 bp, Homo sapiens
cagaccagagtgcagtggtgtaatctctgctcactgcagcctctacctcccgggttcaagcgattctcctgtctcagcctcccaagtagctgggactacaggcgtatgcacacacacccggctaattgtgtatttttagtagtgacggggtttcaccatgttaaccaggctggtctcaaactcctgacctcaggtgatccacccgcctcagtgagccactgtgcccggccaaaaagattttttagattgggatataactagtattcagtaaagtgcacacgtcttaattataaggcttcatgaattattatattcatatacacccatgtatctacctccctcatacccccatcaagatacagaacatttccagcatcgtagaaggctgtctccttcatgccccctttccagtcaatgtcttcttccaggagaaatcattatttttaacctttatcaccatagatttgtgcctgtatttgaacatcatataaatggaatcatacagtattctgctgtgtctgatgtctttcacgaaacatactgtctgtgagggttattcaggttgtcaagggtatcattagtttattcatttattttgctgagtcatattccattgtatggatgtatttaccctttctgctgtttatgggcatttgggatgttctgtaagtttttattacgtattatttttattattgtttagttctaagaattgttaaatttctattattatttctttattttgtttttcagaagaatatatattttaatttccaaacaa

SEQ ID NO: 435323 - DNA, 599 bp, Homo sapiens
gggagatggcccaggacctgttgagtcccagagatgtggggatgtcctgagcagttctagggagctcagggcaggaggcttggctttggtagtacttagtggctcaagcggcttgggtgacagataagtctgtgcatgttccagggcggcattgacacccgggttcggggtgtggaggtcctgggccctaagcccacattctggccactgttccgggagcagctgtgtcgccgaacatgtctcttctacacaattcgggcacaagcctggagccgggacatagcagaggaccaccggcgcctcctccagctctgtcccagactgaacagggttttgcgccacgagcagaattttgctgaccgcttcctccctgatgatgaggccgcccaggcactgggcaagacctgctgggaggccctggtcagccccctggtgcagaacatcacctctcccggtaaccatgctgacacctggccccactaaccagttccttgtccttattcccagggatcacctgagttaatgctcttggttcttttggttcctgtctttatccctgaaggcctgtcacctcagtgttcctctctccttcctgcccc

SEQ ID NO: 435324 - DNA, 523 bp, Homo sapiens
  misc_feature (92)..(92): n is a, c, g, or t
ggtaactacagtaacataaggtatatgagactcttataggataggagaggtaaagatgttcttcacggaggatcaagccttctctgtatgtncacacttgtcctggtctgtctcgaggtcaccttctggtgctttctgatccgcattttgttgaataagaagtaaacctgcgtccgaggagctgcggcggggtaaggtctacctggccaggtagacctaaccaccacactctgggagaccagattataacccaagagctgagagacacgttgtttaggcactcagggatagcaccaagaacagaacctatgcctaccacacgcaccatcctcatgatgcttctcaatcgctactcagagccgccgggcagccctgagcgtgcaggtaccattgtggaggggtggttttgcagaggaatcacacagtgccagccaggtttacatatcagctccttactggaaagatacaaggaaacttcaggaaatgagcaagcattgtgctcaagttaggtcttaagtagaac

SEQ ID NO: 435325 - DNA, 3837 bp, Homo sapiens
cgcatatcttgtgtaagaacggtatcacgaatgacttctcatgattcctgtcatgttccgagataatacgctgaggctgttatttacatatttgaagtgctccatgtcatacatcgtacgatcctctatactcgagatgcgagctgtcaggcttgctagcttggcgctcggtcgacgtcgtcatgactggtcaatgcctggcggctggcgtgatctttctccctcctctgccctgagctgtctgttctcccatctcccatggagacctgttcctgacctgtcttctttcagatgcggaaggcgtgagtgccctgggatggctgctggatcagtacttagaacagagagagacctctcggaaccccttgagtcgagcagcgtcctttgcttctcgagttcgtcgcctttgccacttgctggtgcatgtggaacctcctcctgggccttctcctgagccatccactcggcccttcagcaagaacagcaagggtcgggaccggagcccggcgccttcgccagtgcttccaagcagcagcctgaggaacataacccagtgctggctgagcgtggtgcaggagcaggtcagcagattcctggctgcagcttggagggccccagactttgtgcctcgttactgtaaactctatgagcacttgcagagagcaggctccgagctgtttgggcctcgggcagccttcatgctggctctgcgcagtggcttctctggcgccttgctgcagcagtccttcctcactgctgctcacatgagtgagcagtttgccaggtacattgaccaacagatccagggtggcctgattggtggagcccctggagtggaaatgctggggcagcttcagcggcacctggaacccattatggtcctttctggtctggaactggccacaacttttgagcacttctatcagcattatatggcggaccgtctcctgagctttggttcgagctggctggagggggctgtgctagagcagattggcctctgttttcccaaccgcctcccacagctgatgctgcagagcctgagcacctctgaggagctgcagcgccagttccacctcttccagctccagcggctcgacaagttgttcttggagcaggaagatgaggaggaaaagagactagaggaagaggaggaggaagaggaggaagaggaagctgagaaagaattatttatcgaagatccaagtccagccatttctatactggtcctgtcaccacgctgctggcccgtctccccactctgctacctgtaccatcccagaaagtgccttcccacagaattctgtgatgcccttgaccgtttctccagtttctacagccagagtcagaaccatccagtcctggacatgggaccacatcggcgactgcagtggacgtggctgggccgggctgagctgcagtttgggaagcagatactgcatgtgtccaccgtgcagatgtggctgctgctgaaattcaatcagacagaggaggtgtcagtagagaccttgctgaaggattctgacctctccccagagctgctgctccaggcactcgtgcccctcacctcagggaatggccctttgaccctgcatgagggccaggactttccacacgggggtgtgctgcggcttcatgagcctgggccccagcgcagtggggaggccctgtggctgatacctccccaggcatacctgaacgtagagaaggatgaaggccgaaccctggaacagaagaggaatctcttgagctgtcttcttgttcgtattctcaaagcccatggggaaaagggcctccacattgatcagctggtttgtctggtgctggaggcctggcagaagggtccaaatcctcctggaaccctgggccacactgttgctgggggtgtggcctgtaccagtacagatgtcctctcttgcatcctgcacctcttaggccagggctacgtgaaacggcgtgatgaccggccccagatcctgatgtatgccgctccagagcccatggggccctgccggggtcaggcagatgtccctttctgtggcagccagagcgaaacctccaagcccagcccagaagctgtggctaccctggcatctctacagctgcctgcaggccgcaccatgagcccccaggaagtagaagggttgatgaagcagacggtgcgtcaggtgcaggagacgctgaacttagagccagatgtcgctcagcaccttttggctcattcccactggggcgctgaacagctgctgcagagctacagtgaggaccctgagccactgctgctggcagctgggctgtgcgtacaccaggctcaggctgtacccgtacggcctgaccactgccccgtctgtgtgagccccctggggtgtgacgacgacctgccctctctctgctgcatgcactattgctgtaagtcttgctggaatgagtacctgacaactcggatcgagcagaaccttgttttgaattgcacctgccccattgccgactgccccgcccagcccaccggagccttcattcgtgccatcgtctcctcgccagaggtcatctccaagtatgagaaggcgctcctgcgtggctatgtggagagctgctccaacctgacctggtgcaccaacccccagggctgcgaccgcatcctgtgccgccagggcctgggctgtgggaccacctgctccaagtgtggctgggcctcttgcttcaactgtagcttccctgaggcacactaccctgctagctgtggccatatgtctcagtgggtcgacgacggtggctactatgacggcatgagcgtggaggcgcagagcaagcacctggccaagctcatctccaagcgctgtcccagctgtcaggctcccatcgagaagaacgaggggtgcctgcacatgacctgtgccaaatgtaaccatggattctgctggcgctgcctcaagtcctggaagccaaatcacaaagactattacaactgctctgccatggtaagcaaggcagctcgccaggagaagcggtttcaggactataatgagaggtgcactttccatcaccaggcgcgggagtttgctgtgaacttgcggaaccgggtgtctgccatccatgaagtgcccccgcccagatccttcaccttcctcaatgatgcctgccagggactggagcaggctcggaaggtgctggcctacgcctgcgtgtacagcttctacagccaggacgcagagtacatggatgtggtggagcagcagacagagaacctggagctgcacaccaatgccctgcagatcctcctggaggaaaccctgctgcggtgcagagacctggcctcctccctgcgcctcctgcgggccgactgcctcagcacgggcatggagctgctccggcggatccaggagaggctgcttgccatcctgcagcattctgcccaggatttccgggttggtcttcagagtccatcagtagaggcctgggaggcaaaaggacccaacatgcctggcagtcagccccaggcctcctcagggccagaggcagaagaggaggaggaagacgatgaggatgatgtgcccgagtggcagcaggatgagtttgatgaggagctggacaatgacagcttctcctacgatgagtctgagaacctggaccaagagactttcttctttggtgatgaggaagaggatgaagatgaggcctatgactgagggggcagatgcaggaaacacctagagcagccccagagtcacggggctgagggggcgggagctgcccctgtcatagggagggggattcccagcgtctgtagtgcttcctgtttgctgaataaaggtctctttctcacacacaaaaaaaaaa

SEQ ID NO: 435326 - DNA, 3229 bp, Homo sapiens
tgtattagctggaatgctttcaagagaaaccctttcactaactgtttatctaccctgaagtccggtttatacaggaaaggcttgattgtttccacttccaattatttttaactcattttaaaaataatatggtggttctctagtaacttttaaataaaaccaatgaggtcttttaaaaatatatcattatgaactcacagattttaaaatattttgtgtggttccatcacacattgcaggtggatttttttttttttggattctcaaattgtcccatctttggtaagacagcatctctcaggcaggctcctagtccctttaatactctccctttgacagcttccttgctttccagtatgaacagatgtctcaggctcaccttgcctgagctgtgaaacaggaggaggaagagatccagcccagtgggtctttaaaactgtgagctccttgagggcaaaatgcaagtgttttctctctggtgtttttgcatggaacctgcctggctcagggctaggcgctgggtctagggatgggctcctagatacccgtggctcatcagggaggcaggcgcagggaaggctgagatctggaagcttgacaaggtatctctctgtctgaaaatgctggggccctcctccccatagggactagtaggagcaaagcttgacacctcaacccctaaaccccttgtttcgcccattctgtgtctccacccttctccttgacacttgcctaggtcagaaccatccagtcctggacatgggaccacatcggcgactgcagtggacgtggctgggccgggctgagctgcagtttgggaagcagatactgcatgtgtccaccgtgcagatgtggctgctgctgaaattcaatcagacagaggaggtgtcagtagagaccttgctgaaggattctgacctctccccagagctgctgctccaggcactcgtgcccctcacctcagggaatggccctttgaccctgcatgagggccaggactttccacacgggggtgtgctgcggcttcatgagcctgggccccagcgcagtggggaggccctgtggctgatacctccccaggcatacctgaacgtagagaaggatgaaggccgaaccctggaacagaagaggaatctcttgagctgtcttcttgttcgtattctcaaagcccatggggaaaagggcctccacattgatcagctggtttgtctggtgctggaggcctggcagaagggtccaaatcctcctggaaccctgggccacactgttgctgggggtgtggcctgtaccagtacagatgtcctctcttgcatcctgcacctcttaggccagggctacgtgaaacggcgtgatgaccggccccagatcctgatgtatgccgctccagagcccatggggccctgccggggtcaggcagatgtccctttctgtggcagccagagcgaaacctccaagcccagcccagaagctgtggctaccctggcatctctacagctgcctgcaggccgcaccatgagcccccaggaagtagaagggttgatgaagcagacggtgcgtcaggtgcaggagacgctgaacttagagccagatgtcgctcagcaccttttggctcattcccactggggcgctgaacagctgctgcagagctacagtgaggaccctgagccactgctgctggcagctgggctgtgcgtacaccaggctcaggctgtacccgtacggcctgaccactgccccgtctgtgtgagccccctggggtgtgacgacgacctgccctctctctgctgcatgcactattgctgtaagtcttgctggaatgagtacctgacaactcggatcgagcagaaccttgttttgaattgcacctgccccattgccgactgccccgcccagcccaccggagccttcattcgtgccatcgtctcctcgccagaggtcatctccaagtatgagaaggcgctcctgcgtggctatgtggagagctgctccaacctgacctggtgcaccaacccccagggctgcgaccgcatcctgtgccgccagggcctgggctgtgggaccacctgctccaagtgtggctgggcctcttgcttcaactgtagcttccctgaggcacactaccctgctagctgtggccatatgtctcagtgggtcgacgacggtggctactatgacggcatgagcgtggaggcgcagagcaagcacctggccaagctcatctccaagcgctgtcccagctgtcaggctcccatcgagaagaacgaggggtgcctgcacatgacctgtgccaaatgtaaccatggattctgctggcgctgcctcaagtcctggaagccaaatcacaaagactattacaactgctctgccatggtaagcaaggcagctcgccaggagaagcggtttcaggactataatgagaggtgcactttccatcaccaggcgcgggagtttgctgtgaacttgcggaaccgggtgtctgccatccatgaagtgcccccgcccagatccttcaccttcctcaatgatgcctgccagggactggagcaggctcggaaggtgctggcctacgcctgcgtgtacagcttctacagccaggacgcagagtacatggatgtggtggagcagcagacagagaacctggagctgcacaccaatgccctgcagatcctcctggaggaaaccctgctgcggtgcagagacctggcctcctccctgcgcctcctgcgggccgactgcctcagcacgggcatggagctgctccggcggatccaggagaggctgcttgccatcctgcagcattctgcccaggatttccgggttggtcttcagagtccatcagtagaggcctgggaggcaaaaggacccaacatgcctggcagtcagccccaggcctcctcagggccagaggcagaagaggaggaggaagacgatgaggatgatgtgcccgagtggcagcaggatgagtttgatgaggagctggacaatgacagcttctcctacgatgagtctgagaacctggaccaagagactttcttctttggtgatgaggaagaggatgaagatgaggcctatgactgagggggcagatgcaggaaacacctagagcagccccagagtcacggggctgagggggcgggagctgcccctgtcatagggagggggattcccagcgtctgtagtgcttcctgtttgctgaataaaggtctctttctcacacacaaaaaaaaaa

SEQ ID NO: 435327 - DNA, 4946 bp, Homo sapiens
ccaggctgaatggtgggagctgcttttctttatcaaaaagttggacttgtgtgagcagcagccaattttccagaatctttggaagaacctggatgagaccctgggtgaaaaggccctaggtgagatctctgtgtccgtggaaatggccgagagtctgctgcaggttctcagtagtcgatttgagggcagcactctcaatgacctgctcaactcccagatctacaccaagtatgggctgctgtctaatgaaccaagcagctcgtctacttcacgaaatcactcctgtaccccagatccagaagaggagtccaagtcggaggccagcttctcagaggaagagactgagtccctcaaagcaaaggccgaggcccctaagacagaggccgagcccaccaagacaaggaccgagacccccatggcacagagtgattctcagctgtttaaccagcttctggtgactgaggggatgaccctgcccactgagatgaaggaggcagccagtgaaatggccagagccttgcggggtcccggtcctcgcagctccctggatcagcatgtggcagcggtcgtggccactgtgcagatatccagcttggacacaaacctgcagctttcagggctctctgccctctctcaggctgtggaggaggtcactgagcgggaccaccctctggtccgtcctgacagatcgctgagagagaagctagtgaagatgctggtggagctgctgaccaaccaggtgggagagaagatggtggtcgtgcaggccctgcgcctcctttacctgctcatgaccaagcacgagtggcggccgctctttgccagggagggtggcatctatgctgtgctggtctgcatgcaagaatataagacttctgtcttggtgcagcaggctgggctggcggcactgaagatgctggccgtcgccagctcctcggagatccccacttttgttactggccgagattctatccactctttgtttgatgctcagatgaccagagagatcttcgccagcatcgactcagccacacgcccgggctctgagagcctgctcctcactgtccctgcagccgtgatcctgatgctgaatactgaggggtgctcttctgcagcgagaaatggcttactcctgctcaacctacttttgtgcaaccaccacactctgggagaccagattataacccaagagctgagagacacgttgtttaggcactcagggatagcaccaagaacagaacctatgcctaccacacgcaccatcctcatgatgcttctcaatcgctactcagagccgccgggcagccctgagcgtgcagcactagagacccccatcatccagggtcaggatgggtcccctgagctactgattcgatccctggttgggggcccatctgcagaactactcctggacttggagcgtgtgctgtgccgtgagggcagccccggaggtgccgtgaggcccctcctcaagcgcctccagcaggagacccagcctttcctcctgttgctgcggactctggatgctccggggcccaacaagactctgctgctgtctgtgctgagggtcataacccgactgctggatttccctgaggcaatggtcctcccctggcacgaggtcttggagccctgcctcaactgcctgagtggccctagcagtgactccgagattgttcaggagctgacctgcttcctacatcgcctggcctcgatgcataaggactatgctgtggtgctctgctgcctgggagcaaaagagatcctctccaaagtcctggacaagcactcagctcagctgctgctgggctgtgagcttcgggacctggtgacagagtgtgagaagtacgcacagctctatagcaacctcacctccagcatcctggccggctgcattcagatggtgctgggccagatcgaagaccacagacgaacccaccaacccatcaatatccccttctttgatgtgttcctcaggcatctctgccagggctccagtgtggaagtgaaggaggacaagtgctgggagaaggtggaggtgtcctccaacccgcaccgagccagcaagctgacggaccacaaccccaagacctactgggagtccaacggcagcaccggctcccactacatcaccctgcacatgcaccgtggtgttcttgttaggcagctcactttgctggtggccagtgaggactcaagctacatgccagccagggtggtggtgtttgggggtgacagcaccagctgcatcggcactgagctcaacacggtgaatgtgatgccctctgccagccgggtgatcctcttggagaacctgaaccgcttctggcccatcatccagatccgcataaagcgctgccagcagggcggcattgacacccgggttcggggtgtggaggtcctgggccctaagcccacattctggccactgttccgggagcagctgtgtcgccgaacatgtctcttctacacaattcgggcacaagcctggagccgggacatagcagaggaccaccggcgcctcctccagctctgtcccagactgaacagggttttgcgccacgagcagaattttgctgaccgcttcctccctgatgatgaggccgcccaggcactgggcaagacctgctgggaggccctggtcagccccctggtgcagaacatcacctctcccgatgcggaaggcgtgagtgccctgggatggctgctggatcagtacttagaacagagagagacctctcggaaccccttgagtcgagcagcgtcctttgcttctcgagttcgtcgcctttgccacttgctggtgcatgtggaacctcctcctgggccttctcctgagccatccactcggcccttcagcaagaacagcaagggtcgggaccggagcccggcgccttcgccagtgcttccaagcagcagcctgaggaacataacccagtgctggctgagcgtggtgcaggagcaggtcagcagattcctggctgcagcttggagggccccagactttgtgcctcgttactgtaaactctatgagcacttgcagagagcaggctccgagctgtttgggcctcgggcagccttcatgctggctctgcgcagtggcttctctggcgccttgctgcagcagtccttcctcactgctgctcacatgagtgagcagtttgccaggtacattgaccaacagatccagggtggcctgattggtggagcccctggagtggaaatgctggggcagcttcagcggcacctggaacccattatggtcctttctggtctggaactggccacaacttttgagcacttctatcagcattatatggcggaccgtctcctgagctttggttcgagctggctggagggggctgtgctagagcagattggcctctgttttcccaaccgcctcccacagctgatgctgcagagcctgagcacctctgaggagctgcagcgccagttccacctcttccagctccagcggctcgacaagttgttcttggagcaggaagatgaggaggaaaagagactagaggaagaggaggaggaagaggaggaagaggaagctgagaaagaattatttatcgaagatccaagtccagccatttctatactggtcctgtcaccacgctgctggcccgtctccccactctgctacctgtaccatcccagaaagtgccttcccacagaattctgtgatgcccttgaccgtttctccagtttctacagccagagtcagaaccatccagtcctggacatgggaccacatcggcgactgcagtggacgtggctgggccgggctgagctgcagtttgggaagcagatactgcatgtgtccaccgtgcagatgtggctgctgctgaaattcaatcagacagaggaggtgtcagtagagaccttgctgaaggattctgacctctccccagagctgctgctccaggcactcgtgcccctcacctcagggaatggccctttgaccctgcatgagggccaggactttccacacgggggtgtgctgcggcttcatgagcctgggccccagcgcagtggggaggccctgtggctgatacctccccaggcatacctgaacgtagagaaggatgaaggccgaaccctggaacagaagaggaatctcttgagctgtcttcttgttcgtattctcaaagcccatggggaaaagggcctccacattgatcagctggtttgtctggtgctggaggcctggcagaagggtccaaatcctcctggaaccctgggccacactgttgctgggggtgtggcctgtaccagtacagatgtcctctcttgcatcctgcacctcttaggccagggctacgtgaaacggcgtgatgaccggccccagatcctgatgtatgccgctccagagcccatggggccctgccggggtcaggcagatgtccctttctgtggcagccagagcgaaacctccaagcccagcccagaagctgtggctaccctggcatctctacagctgcctgcaggccgcaccatgagcccccaggaagtagaagggttgatgaagcagacggtgcgtcaggtgcaggagacgctgaacttagagccagatgtcgctcagcaccttttggctcattcccactggggcgctgaacagctgctgcagagctacagtgaggaccctgagccactgctgctggcagctgggctgtgcgtacaccaggctcaggctgtacccgtacggcctgaccactgccccgtctgtgtgagccccctggggtgtgacgacgacctgccctctctctgctgcatgcactattgctgtaagtcttgctggaatgagtacctgacaactcggatcgagcagaaccttgttttgaattgcactgcccctgtcatagggagggggattcccagcgtctgtagtgcttcctgtttgctgaataaaggtctctttctcacacacaaaaaaaaaa

SEQ ID NO: 435328 - DNA, 3669 bp, Homo sapiens
ccaggctgaatggtgggagctgcttttctttatcaaaaagttggacttgtgtgagcagcagccaattttccagaatctttggaagaacctggatgagaccctgggtgaaaaggccctaggtgagatctctgtgtccgtggaaatggccgagagtctgctgcaggttctcagtagtcgatttgagggcagcactctcaatgacctgctcaactcccagatctacaccaagtatgggctgctgtctaatgaaccaagcagctcgtctacttcacgaaatcactcctgtaccccagatccagaagaggagtccaagtcggaggccagcttctcagaggaagagactgagtccctcaaagcaaaggccgaggcccctaagacagaggccgagcccaccaagacaaggaccgagacccccatggcacagagtgattctcagctgtttaaccagcttctggtgactgaggggatgaccctgcccactgagatgaaggaggcagccagtgaaatggccagagccttgcggggtcccggtcctcgcagctccctggatcagcatgtggcagcggtcgtggccactgtgcagatatccagcttggacacaaacctgcagctttcagggctctctgccctctctcaggctgtggaggaggtcactgagcgggaccaccctctggtccgtcctgacagatcgctgagagagaagctagtgaagatgctggtggagctgctgaccaaccaggtgggagagaagatggtggtcgtgcaggccctgcgcctcctttacctgctcatgaccaagcacgagtggcggccgctctttgccagggagggtggcatctatgctgtgctggtctgcatgcaagaatataagacttctgtcttggtgcagcaggctgggctggcggcactgaagatgctggccgtcgccagctcctcggagatccccacttttgttactggccgagattctatccactctttgtttgatgctcagatgaccagagagatcttcgccagcatcgactcagccacacgcccgggctctgagagcctgctcctcactgtccctgcagccgtgatcctgatgctgaatactgaggggtgctcttctgcagcgagaaatggcttactcctgctcaacctacttttgtgcaaccaccacactctgggagaccagattataacccaagagctgagagacacgttgtttaggcactcagggatagcaccaagaacagaacctatgcctaccacacgcaccatcctcatgatgcttctcaatcgctactcagagccgccgggcagccctgagcgtgcagcactagagacccccatcatccagggtcaggatgggtcccctgagctactgattcgatccctggttgggggcccatctgcagaactactcctggacttggagcgtgtgctgtgccgtgagggcagccccggaggtgccgtgaggcccctcctcaagcgcctccagcaggagacccagcctttcctcctgttgctgcggactctggatgctccggggcccaacaagactctgctgctgtctgtgctgagggtcataacccgactgctggatttccctgaggcaatggtcctcccctggcacgaggtcttggagccctgcctcaactgcctgagtggccctagcagtgactccgagattgttcaggagctgacctgcttcctacatcgcctggcctcgatgcataaggactatgctgtggtgctctgctgcctgggagcaaaagagatcctctccaaagtcctggacaagcactcagctcagctgctgctgggctgtgagcttcgggacctggtgacagagtgtgagaagtacgcacagctctatagcaacctcacctccagcatcctggccggctgcattcagatggtgctgggccagatcgaagaccacagacgaacccaccaacccatcaatatccccttctttgatgtgttcctcaggcatctctgccagggctccagtgtggaagtgaaggaggacaagtgctgggagaaggtggaggtgtcctccaacccgcaccgagccagcaagctgacggaccacaaccccaagacctactgggagtccaacggcagcaccggctcccactacatcaccctgcacatgcaccgtggtgttcttgttaggcagctcactttgctggtggccagtgaggactcaagctacatgccagccagggtggtggtgtttgggggtgacagcaccagctgcatcggcactgagctcaacacggtgaatgtgatgccctctgccagccgggtgatcctcttggagaacctgaaccgcttctggcccatcatccagatccgcataaagcgctgccagcagggcggcattgacacccgggttcggggtgtggaggtcctgggccctaagcccacattctggccactgttccgggagcagctgtgtcgccgaacatgtctcttctacacaattcgggcacaagcctggagccgggacatagcagaggaccaccggcgcctcctccagctctgtcccagactgaacagggttttgcgccacgagcagaattttgctgaccgcttcctccctgatgatgaggccgcccaggcactgggcaagacctgctgggaggccctggtcagccccctggtgcagaacatcacctctcccgatgcggaaggcgtgagtgccctgggatggctgctggatcagtacttagaacagagagagacctctcggaaccccttgagtcgagcagcgtcctttgcttctcgagttcgtcgcctttgccacttgctggtgcatgtggaacctcctcctgggccttctcctgagccatccactcggcccttcagcaagaacagcaagggtcgggaccggagcccggcgccttcgccagtgcttccaagcagcagcctgaggaacataacccagtgctggctgagcgtggtgcaggagcaggtcagcagattcctggctgcagcttggagggccccagactttgtgcctcgttactgtaaactctatgagcacttgcagagagcaggctccgagctgtttgggcctcgggcagccttcatgctggctctgcgcagtggcttctctggcgccttgctgcagcagtccttcctcactgctgctcacatgagtgagcagtttgccaggtacattgaccaacagatccagggtggcctgattggtggagcccctggagtggaaatgctggggcagcttcagcggcacctggaacccattatggtcctttctggtctggaactggccacaacttttgagcacttctatcagtgagtgcaggtctggaggcataggggatgggaggcctagatctagagagtggaaagatttgagtcttataggggagatgagaaaagaggctgtgtagaggagagattaagatgtggagatggctggccaggcgcggtggctcacgcatgtaatcccagcattctggcaggcagatcacctgaggtcaggagttcaagaccagcctgaccaacatggtgaaaccctttctctactaaaaatacaaaaattagccaggttgcaatggtgtgatctcggctcactgcaacctctgcctgatgggttcaagcgattctcctgcctcagcctcctgagtagctgggattacaggcatgcaccac

SEQ ID NO: 435329 - DNA, 617 bp, Homo sapiens
cgcatatcttgtgtaagaacggtatcacgaatgacttctcatgattcctgtcatgttccgagataatacgctgaggctgttatttacatatttgaagtgctccatgtcatacatcgtacgatcctctatactcgagatgcgagctgtcaggcttgctagcttggcgctcggtcgacgtcgtcatgactggtcaatgcctggcggctggcgtgatctttctccctcctctgccctgagctgtctgttctcccatctcccatggagacctgttcctgacctgtcttctttcagatgcggaaggcgtgagtgccctgggatggctgctggatcagtacttagaacagagagagacctctcggaaccccttgagtcgagcagcgtcctttgcttctcgagttcgtcgcctttgccacttgctggtgcatgtggaacctcctcctgggccttctcctgagccatccactcggccctgtaagtcccagctgtggccagtggagctgactctgcggacagtggtgtatctggctccctcctccctgggtcttactcttgctgctttgctaccggcctttccaggcccctgagacctactggcctttccaggagatcactaccca

SEQ ID NO: 435330 - DNA, 826 bp, Homo sapiens
aagactagaccaaggaagggagcccaagggcccttgaaatccttctgtccctcaggaggaagaggaggaagaggaagctgagaaagaattatttatcgaagatccaagtccagccatttctatactggtcctgtcaccacgctgctggcccgtctccccactctgctacctgtaccatcccagaaagtgccttcccacagaattctgtgatgcccttgaccgtttctccagtttctacagccagagtgaggaactagggagaggaaattggagatcggggtgagattcggggtggcaagagaggaagaggagaggacctttggacaggatatagatgtgaagaaaaatatcagctcctagcgagggatgagaaagcatgggttgtagtttcattaatttctgctctcatcagtttcttcaactttctatgaatttgttctgttttctttttctaacttcaagtgaggtgcttatttgatttttagtcttttcagacttttttccaaataaaagtgtttaagactattcatttccctctcaatactgctttagtggcatcctataaagttttaaaagattttttttctttatttttttgacatggagtctcactctgtcacccagaccagagtgcagtggtgtaatctctgctcactgcagcctctacctcccgggttcaagcgattctcctgtctcagcctcccaagtagctgggactacaggcgtatgcacacacacccggctaattgtgtatttttagtagtgacggggtttcaccatgttaaccaggctggtctcaaactcctgacctcaggtgatccacccg

SEQ ID NO: 435331 - DNA, 6221 bp, Homo sapiens
ccaggctgaatggtgggagctgcttttctttatcaaaaagttggacttgtgtgagcagcagccaattttccagaatctttggaagaacctggatgagaccctgggtgaaaaggccctaggtgagatctctgtgtccgtggaaatggccgagagtctgctgcaggttctcagtagtcgatttgagggcagcactctcaatgacctgctcaactcccagatctacaccaagtatgggctgctgtctaatgaaccaagcagctcgtctacttcacgaaatcactcctgtaccccagatccagaagaggagtccaagtcggaggccagcttctcagaggaagagactgagtccctcaaagcaaaggccgaggcccctaagacagaggccgagcccaccaagacaaggaccgagacccccatggcacagagtgattctcagctgtttaaccagcttctggtgactgaggggatgaccctgcccactgagatgaaggaggcagccagtgaaatggccagagccttgcggggtcccggtcctcgcagctccctggatcagcatgtggcagcggtcgtggccactgtgcagatatccagcttggacacaaacctgcagctttcagggctctctgccctctctcaggctgtggaggaggtcactgagcgggaccaccctctggtccgtcctgacagatcgctgagagagaagctagtgaagatgctggtggagctgctgaccaaccaggtgggagagaagatggtggtcgtgcaggccctgcgcctcctttacctgctcatgaccaagcacgagtggcggccgctctttgccagggagggtggcatctatgctgtgctggtctgcatgcaagaatataagacttctgtcttggtgcagcaggctgggctggcggcactgaagatgctggccgtcgccagctcctcggagatccccacttttgttactggccgagattctatccactctttgtttgatgctcagatgaccagagagatcttcgccagcatcgactcagccacacgcccgggctctgagagcctgctcctcactgtccctgcagccgtgatcctgatgctgaatactgaggggtgctcttctgcagcgagaaatggcttactcctgctcaacctacttttgtgcaaccaccacactctgggagaccagattataacccaagagctgagagacacgttgtttaggcactcagggatagcaccaagaacagaacctatgcctaccacacgcaccatcctcatgatgcttctcaatcgctactcagagccgccgggcagccctgagcgtgcagcactagagacccccatcatccagggtcaggatgggtcccctgagctactgattcgatccctggttgggggcccatctgcagaactactcctggacttggagcgtgtgctgtgccgtgagggcagccccggaggtgccgtgaggcccctcctcaagcgcctccagcaggagacccagcctttcctcctgttgctgcggactctggatgctccggggcccaacaagactctgctgctgtctgtgctgagggtcataacccgactgctggatttccctgaggcaatggtcctcccctggcacgaggtcttggagccctgcctcaactgcctgagtggccctagcagtgactccgagattgttcaggagctgacctgcttcctacatcgcctggcctcgatgcataaggactatgctgtggtgctctgctgcctgggagcaaaagagatcctctccaaagtcctggacaagcactcagctcagctgctgctgggctgtgagcttcgggacctggtgacagagtgtgagaagtacgcacagctctatagcaacctcacctccagcatcctggccggctgcattcagatggtgctgggccagatcgaagaccacagacgaacccaccaacccatcaatatccccttctttgatgtgttcctcaggcatctctgccagggctccagtgtggaagtgaaggaggacaagtgctgggagaaggtggaggtgtcctccaacccgcaccgagccagcaagctgacggaccacaaccccaagacctactgggagtccaacggcagcaccggctcccactacatcaccctgcacatgcaccgtggtgttcttgttaggcagctcactttgctggtggccagtgaggactcaagctacatgccagccagggtggtggtgtttgggggtgacagcaccagctgcatcggcactgagctcaacacggtgaatgtgatgccctctgccagccgggtgatcctcttggagaacctgaaccgcttctggcccatcatccagatccgcataaagcgctgccagcagggcggcattgacacccgggttcggggtgtggaggtcctgggccctaagcccacattctggccactgttccgggagcagctgtgtcgccgaacatgtctcttctacacaattcgggcacaagcctggagccgggacatagcagaggaccaccggcgcctcctccagctctgtcccagactgaacagggttttgcgccacgagcagaattttgctgaccgcttcctccctgatgatgaggccgcccaggcactgggcaagacctgctgggaggccctggtcagccccctggtgcagaacatcacctctcccgatgcggaaggcgtgagtgccctgggatggctgctggatcagtacttagaacagagagagacctctcggaaccccttgagtcgagcagcgtcctttgcttctcgagttcgtcgcctttgccacttgctggtgcatgtggaacctcctcctgggccttctcctgagccatccactcggcccttcagcaagaacagcaagggtcgggaccggagcccggcgccttcgccagtgcttccaagcagcagcctgaggaacataacccagtgctggctgagcgtggtgcaggagcaggtcagcagattcctggctgcagcttggagggccccagactttgtgcctcgttactgtaaactctatgagcacttgcagagagcaggctccgagctgtttgggcctcgggcagccttcatgctggctctgcgcagtggcttctctggcgccttgctgcagcagtccttcctcactgctgctcacatgagtgagcagtttgccaggtacattgaccaacagatccagggtggcctgattggtggagcccctggagtggaaatgctggggcagcttcagcggcacctggaacccattatggtcctttctggtctggaactggccacaacttttgagcacttctatcagcattatatggcggaccgtctcctgagctttggttcgagctggctggagggggctgtgctagagcagattggcctctgttttcccaaccgcctcccacagctgatgctgcagagcctgagcacctctgaggagctgcagcgccagttccacctcttccagctccagcggctcgacaagttgttcttggagcaggaagatgaggaggaaaagagactagaggaagaggaggaggaagaggaggaagaggaagctgagaaagaattatttatcgaagatccaagtccagccatttctatactggtcctgtcaccacgctgctggcccgtctccccactctgctacctgtaccatcccagaaagtgccttcccacagaattctgtgatgcccttgaccgtttctccagtttctacagccagagtcagaaccatccagtcctggacatgggaccacatcggcgactgcagtggacgtggctgggccgggctgagctgcagtttgggaagcagatactgcatgtgtccaccgtgcagatgtggctgctgctgaaattcaatcagacagaggaggtgtcagtagagaccttgctgaaggattctgacctctccccagagctgctgctccaggcactcgtgcccctcacctcagggaatggccctttgaccctgcatgagggccaggactttccacacgggggtgtgctgcggcttcatgagcctgggccccagcgcagtggggaggccctgtggctgatacctccccaggcatacctgaacgtagagaaggatgaaggccgaaccctggaacagaagaggaatctcttgagctgtcttcttgttcgtattctcaaagcccatggggaaaagggcctccacattgatcagctggtttgtctggtgctggaggcctggcagaagggtccaaatcctcctggaaccctgggccacactgttgctgggggtgtggcctgtaccagtacagatgtcctctcttgcatcctgcacctcttaggccagggctacgtgaaacggcgtgatgaccggccccagatcctgatgtatgccgctccagagcccatggggccctgccggggtcaggcagatgtccctttctgtggcagccagagcgaaacctccaagcccagcccagaagctgtggctaccctggcatctctacagctgcctgcaggccgcaccatgagcccccaggaagtagaagggttgatgaagcagacggtgcgtcaggtgcaggagacgctgaacttagagccagatgtcgctcagcaccttttggctcattcccactggggcgctgaacagctgctgcagagctacagtgaggaccctgagccactgctgctggcagctgggctgtgcgtacaccaggctcaggctgtacccgtacggcctgaccactgccccgtctgtgtgagccccctggggtgtgacgacgacctgccctctctctgctgcatgcactattgctgtaagtcttgctggaatgagtacctgacaactcggatcgagcagaaccttgttttgaattgcacctgccccattgccgactgccccgcccagcccaccggagccttcattcgtgccatcgtctcctcgccagaggtcatctccaagtatgagaaggcgctcctgcgtggctatgtggagagctgctccaacctgacctggtgcaccaacccccagggctgcgaccgcatcctgtgccgccagggcctgggctgtgggaccacctgctccaagtgtggctgggcctcttgcttcaactgtagcttccctgaggcacactaccctgctagctgtggccatatgtctcagtgggtcgacgacggtggctactatgacggcatgagcgtggaggcgcagagcaagcacctggccaagctcatctccaagcgctgtcccagctgtcaggctcccatcgagaagaacgaggggtgcctgcacatgacctgtgccaaatgtaaccatggattctgctggcgctgcctcaagtcctggaagccaaatcacaaagactattacaactgctctgccatggtaagcaaggcagctcgccaggagaagcggtttcaggactataatgagaggtgcactttccatcaccaggcgcgggagtttgctgtgaacttgcggaaccgggtgtctgccatccatgaagtgcccccgcccagatccttcaccttcctcaatgatgcctgccagggactggagcaggctcggaaggtgctggcctacgcctgcgtgtacagcttctacagccaggacgcagagtacatggatgtggtggagcagcagacagagaacctggagctgcacaccaatgccctgcagatcctcctggaggaaaccctgctgcggtgcagagacctggcctcctccctgcgcctcctgcgggccgactgcctcagcacgggcatggagctgctccggcggatccaggagaggctgcttgccatcctgcagcattctgcccaggatttccgggttggtcttcagagtccatcagtagaggcctgggaggcaaaaggacccaacatgcctggcagtcagccccaggcctcctcagggccagaggcagaagaggaggaggaagacgatgaggatgatgtgcccgagtggcagcaggatgagtttgatgaggagctggacaatgacagcttctcctacgatgagtctgagaacctggaccaagagactttcttctttggtgatgaggaagaggatgaagatgaggcctatgactgagggggcagatgcaggaaacacctagagcagccccagagtcacggggctgagggggcgggagctgcccctgtcatagggagggggattcccagcgtctgtagtgcttcctgtttgctgaataaaggtctctttctcacacacaaaaaaaaaa

SEQ ID NO: 435332 - DNA, 6103 bp, Homo sapiens
ccaggctgaatggtgggagctgcttttctttatcaaaaagttggacttgtgtgagcagcagccaattttccagaatctttggaagaacctggatgagaccctgggtgaaaaggccctaggtgagatctctgtgtccgtggaaatggccgagagtctgctgcaggttctcagtagtcgatttgagggcagcactctcaatgacctgctcaactcccagatctacaccaagtatgggctgctgtctaatgaaccaagcagctcgtctacttcacgaaatcactcctgtaccccagatccagaagaggagtccaagtcggaggccagcttctcagaggaagagactgagtccctcaaagcaaaggccgaggcccctaagacagaggccgagcccaccaagacaaggaccgagacccccatggcacagagtgattctcagctgtttaaccagcttctggtgactgaggggatgaccctgcccactgagatgaaggaggcagccagtgaaatggccagagccttgcggggtcccggtcctcgcagctccctggatcagcatgtggcagcggtcgtggccactgtgcagatatccagcttggacacaaacctgcagctttcagggctctctgccctctctcaggctgtggaggaggtcactgagcgggaccaccctctggtccgtcctgacagatcgctgagagagaagctagtgaagatgctggtggagctgctgaccaaccaggtgggagagaagatggtggtcgtgcaggccctgcgcctcctttacctgctcatgaccaagcacgagtggcggccgctctttgccagggagggtggcatctatgctgtgctggtctgcatgcaagaatataagacttctgtcttggtgcagcaggctgggctggcggcactgaagatgctggccgtcgccagctcctcggagatccccacttttgttactggccgagattctatccactctttgtttgatgctcagatgaccagagagatcttcgccagcatcgactcagccacacgcccgggctctgagagcctgctcctcactgtccctgcagccgtgatcctgatgctgaatactgaggggtgctcttctgcagcgagaaatggcttactcctgctcaacctacttttgtgcaaccaccacactctgggagaccagattataacccaagagctgagagacacgttgtttaggcactcagggatagcaccaagaacagaacctatgcctaccacacgcaccatcctcatgatgcttctcaatcgctactcagagccgccgggcagccctgagcgtgcagcactagagacccccatcatccagggtcaggatgggtcccctgagctactgattcgatccctggttgggggcccatctgcagaactactcctggacttggagcgtgtgctgtgccgtgagggcagccccggaggtgccgtgaggcccctcctcaagcgcctccagcaggagacccagcctttcctcctgttgctgcggactctggatgctccggggcccaacaagactctgctgctgtctgtgctgagggtcataacccgactgctggatttccctgaggcaatggtcctcccctggcacgaggtcttggagccctgcctcaactgcctgagtggccctagcagtgactccgagattgttcaggagctgacctgcttcctacatcgcctggcctcgatgcataaggactatgctgtggtgctctgctgcctgggagcaaaagagatcctctccaaagtcctggacaagcactcagctcagctgctgctgggctgtgagcttcgggacctggtgacagagtgtgagaagtacgcacagctctatagcaacctcacctccagcatcctggccggctgcattcagatggtgctgggccagatcgaagaccacagacgaacccaccaacccatcaatatccccttctttgatgtgttcctcaggcatctctgccagggctccagtgtggaagtgaaggaggacaagtgctgggagaaggtggaggtgtcctccaacccgcaccgagccagcaagctgacggaccacaaccccaagacctactgggagtccaacggcagcaccggctcccactacatcaccctgcacatgcaccgtggtgttcttgttaggcagctcactttgctggtggccagtgaggactcaagctacatgccagccagggtggtggtgtttgggggtgacagcaccagctgcatcggcactgagctcaacacggtgaatgtgatgccctctgccagccgggtgatcctcttggagaacctgaaccgcttctggcccatcatccagatccgcataaagcgctgccagcagggcggcattgacacccgggttcggggtgtggaggtcctgggccctaagcccacattctggccactgttccgggagcagctgtgtcgccgaacatgtctcttctacacaattcgggcacaagcctggagccgggacatagcagaggaccaccggcgcctcctccagctctgtcccagactgaacagggttttgcgccacgagcagaattttgctgaccgcttcctccctgatgatgaggccgcccaggcactgggcaagacctgctgggaggccctggtcagccccctggtgcagaacatcacctctcccgatgcggaaggcgtgagtgccctgggatggctgctggatcagtacttagaacagagagagacctctcggaaccccttgagtcgagcagcgtcctttgcttctcgagttcgtcgcctttgccacttgctggtgcatgtggaacctcctcctgggccttctcctgagccatccactcggcccttcagcaagaacagcaagggtcgggaccggagcccggcgccttcgccagtgcttccaagcagcagcctgaggaacataacccagtgctggctgagcgtggtgcaggagcaggtcagcagattcctggctgcagcttggagggccccagactttgtgcctcgttactgtaaactctatgagcacttgcagagagcaggctccgagctgtttgggcctcgggcagccttcatgctggctctgcgcagtggcttctctggcgccttgctgcagcagtccttcctcactgctgctcacatgagtgagcagtttgccaggtacattgaccaacagatccagggtggcctgattggtggagcccctggagtggaaatgctggggcagcttcagcggcacctggaacccattatggtcctttctggtctggaactggccacaacttttgagcacttctatcagcattatatggcggaccgtctcctgagctttggttcgagctggctggagggggctgtgctagagcagattggcctctgttttcccaaccgcctcccacagctgatgctgcagagcctgagcacctctgaggagctgcagcgccagttccacctcttccagctccagcggctcgacaagttgttcttggagcaggaagatgaggaggaaaagagactagaggaagaggaggaggaagaggaggaagaggaagctgagaaagaattatttatcgaagatccaagtccagccatttctatactggtcctgtcaccacgctgctggcccgtctccccactctgctacctgtaccatcccagaaagtgccttcccacagaattctgtgatgcccttgaccgtttctccagtttctacagccagagtcagaaccatccagtcctggacatgggaccacatcggcgactgcagtggacgtggctgggccgggctgagctgcagtttgggaagcagatactgcatgtgtccaccgtgcagatgtggctgctgctgaaattcaatcagacagaggaggtgtcagtagagaccttgctgaaggattctgacctctccccagagctgctgctccaggcactcgtgcccctcacctcagggaatggccctttgaccctgcatgagggccaggactttccacacgggggtgtgctgcggcttcatgagcctgggccccagcgcagtggggaggccctgtggctgatacctccccaggcatacctgaacgtagagaaggatgaaggccgaaccctggaacagaagaggaatctcttgagctgtcttcttgttcgtattctcaaagcccatggggaaaagggcctccacattgatcagctggtttgtctggtgctggaggcctggcagaagggtccaaatcctcctggaaccctgggccacactgttgctgggggtgtggcctgtaccagtacagatgtcctctcttgcatcctgcacctcttaggccagggctacgtgaaacggcgtgatgaccggccccagatcctgatgtatgccgctccagagcccatggggccctgccggggtcaggcagatgtccctttctgtggcagccagagcgaaacctccaagcccagcccagaagctgtggctaccctggcatctctacagctgcctgcaggccgcaccatgagcccccaggaagtagaagggttgatgaagcagacggtgcgtcaggtgcaggagacgctgaacttagagccagatgtcgctcagcaccttttggctcattcccactggggcgctgaacagctgctgcagagctacagtgaggaccctgagccactgctgctggcagctgggcttcttgctggaatgagtacctgacaactcggatcgagcagaaccttgttttgaattgcacctgccccattgccgactgccccgcccagcccaccggagccttcattcgtgccatcgtctcctcgccagaggtcatctccaagtatgagaaggcgctcctgcgtggctatgtggagagctgctccaacctgacctggtgcaccaacccccagggctgcgaccgcatcctgtgccgccagggcctgggctgtgggaccacctgctccaagtgtggctgggcctcttgcttcaactgtagcttccctgaggcacactaccctgctagctgtggccatatgtctcagtgggtcgacgacggtggctactatgacggcatgagcgtggaggcgcagagcaagcacctggccaagctcatctccaagcgctgtcccagctgtcaggctcccatcgagaagaacgaggggtgcctgcacatgacctgtgccaaatgtaaccatggattctgctggcgctgcctcaagtcctggaagccaaatcacaaagactattacaactgctctgccatggtaagcaaggcagctcgccaggagaagcggtttcaggactataatgagaggtgcactttccatcaccaggcgcgggagtttgctgtgaacttgcggaaccgggtgtctgccatccatgaagtgcccccgcccagatccttcaccttcctcaatgatgcctgccagggactggagcaggctcggaaggtgctggcctacgcctgcgtgtacagcttctacagccaggacgcagagtacatggatgtggtggagcagcagacagagaacctggagctgcacaccaatgccctgcagatcctcctggaggaaaccctgctgcggtgcagagacctggcctcctccctgcgcctcctgcgggccgactgcctcagcacgggcatggagctgctccggcggatccaggagaggctgcttgccatcctgcagcattctgcccaggatttccgggttggtcttcagagtccatcagtagaggcctgggaggcaaaaggacccaacatgcctggcagtcagccccaggcctcctcagggccagaggcagaagaggaggaggaagacgatgaggatgatgtgcccgagtggcagcaggatgagtttgatgaggagctggacaatgacagcttctcctacgatgagtctgagaacctggaccaagagactttcttctttggtgatgaggaagaggatgaagatgaggcctatgactgagggggcagatgcaggaaacacctagagcagccccagagtcacggggctgagggggcgggagctgcccctgtcatagggagggggattcccagcgtctgtagtgcttcctgtttgctgaataaaggtctctttctcacacacaaaaaaaaaa

SEQ ID NO: 435333 - DNA, 6168 bp, Homo sapiens
ccaggctgaatggtgggagctgcttttctttatcaaaaagttggacttgtgtgagcagcagccaattttccagaatctttggaagaacctggatgagaccctgggtgaaaaggccctaggtgagatctctgtgtccgtggaaatggccgagagtctgctgcaggttctcagtagtcgatttgagggcagcactctcaatgacctgctcaactcccagatctacaccaagtatgggctgctgtctaatgaaccaagcagctcgtctacttcacgaaatcactcctgtaccccagatccagaagaggagtccaagtcggaggccagcttctcagaggaagagactgagtccctcaaagcaaaggccgaggcccctaagacagaggccgagcccaccaagacaaggaccgagacccccatggcacagagtgattctcagctgtttaaccagcttctggtgactgaggggatgaccctgcccactgagatgaaggaggcagccagtgaaatggccagagccttgcggggtcccggtcctcgcagctccctggatcagcatgtggcagcggtcgtggccactgtgcagatatccagcttggacacaaacctgcagctttcagggctctctgccctctctcaggctgtggaggaggtcactgagcgggaccaccctctggtccgtcctgacagatcgctgagagagaagctagtgaagatgctggtggagctgctgaccaaccaggtgggagagaagatggtggtcgtgcaggccctgcgcctcctttacctgctcatgaccaagcacgagtggcggccgctctttgccagggagggtggcatctatgctgtgctggtctgcatgcaagaatataagacttctgtcttggtgcagcaggctgggctggcggcactgaagatgctggccgtcgccagctcctcggagatccccacttttgttactggccgagattctatccactctttgtttgatgctcagatgaccagagagatcttcgccagcatcgactcagccacacgcccgggctctgagagcctgctcctcactgtccctgcagccgtgatcctgatgctgaatactgaggggtgctcttctgcagcgagaaatggcttactcctgctcaacctacttttgtgcaaccaccacactctgggagaccagattataacccaagagctgagagacacgttgtttaggcactcagggatagcaccaagaacagaacctatgcctaccacacgcaccatcctcatgatgcttctcaatcgctactcagagccgccgggcagccctgagcgtgcagcactagagacccccatcatccagggtcaggatgggtcccctgagctactgattcgatccctggttgggggcccatctgcagaactactcctggacttggagcgtgtgctgtgccgtgagggcagccccggaggtgccgtgaggcccctcctcaagcgcctccagcaggagacccagcctttcctcctgttgctgcggactctggatgctccggggcccaacaagactctgctgctgtctgtgctgagggtcataacccgactgctggatttccctgaggcaatggtcctcccctggcacgaggtcttggagccctgcctcaactgcctgagtggccctagcagtgactccgagattgttcaggagctgacctgcttcctacatcgcctggcctcgatgcataaggactatgctgtggtgctctgctgcctgggagcaaaagagatcctctccaaagtcctggacaagcactcagctcagctgctgctgggctgtgagcttcgggacctggtgacagagtgtgagaagtacgcacagctctatagcaacctcacctccagcatcctggccggctgcattcagatggtgctgggccagatcgaagaccacagacgaacccaccaacccatcaatatccccttctttgatgtgttcctcaggcatctctgccagggctccagtgtggaagtgaaggaggacaagtgctgggagaaggtggaggtgtcctccaacccgcaccgagccagcaagctgacggaccacaaccccaagacctactgggagtccaacggcagcaccggctcccactacatcaccctgcacatgcaccgtggtgttcttgttaggcagctcactttgctggtggccagtgaggactcaagctacatgccagccagggtggtggtgtttgggggtgacagcaccagctgcatcggcactgagctcaacacggtgaatgtgatgccctctgccagccgggtgatcctcttggagaacctgaaccgcttctggcccatcatccagatccgcataaagcgctgccagcagggcggcattgacacccgggttcggggtgtggaggtcctgggccctaagcccacattctggccactgttccgggagcagctgtgtcgccgaacatgtctcttctacacaattcgggcacaagcctggagccgggacatagcagaggaccaccggcgcctcctccagctctgtcccagactgaacagggttttgcgccacgagcagaattttgctgaccgcttcctccctgatgatgaggccgcccaggcactgggcaagacctgctgggaggccctggtcagccccctggtgcagaacatcacctctcccgatgcggaaggcgtgagtgccctgggatggctgctggatcagtacttagaacagagagagacctctcggaaccccttgagtcgagcagcgtcctttgcttctcgagttcgtcgcctttgccacttgctggtgcatgtggaacctcctcctgggccttctcctgagccatccactcggcccttcagcaagaacagcaagggtcgggaccggagcccggcgccttcgccagtgcttccaagcagcagcctgaggaacataacccagtgctggctgagcgtggtgcaggagcaggtcagcagattcctggctgcagcttggagggccccagactttgtgcctcgttactgtaaactctatgagcacttgcagagagcaggctccgagctgtttgggcctcgggcagccttcatgctggctctgcgcagtggcttctctggcgccttgctgcagcagtccttcctcactgctgctcacatgagtgagcagtttgccaggtacattgaccaacagatccagggtggcctgattggtggagcccctggagtggaaatgctggggcagcttcagcggcacctggaacccattatggtcctttctggtctggaactggccacaacttttgagcacttctatcagcattatatggcggaccgtctcctgagctttggttcgagctggctggagggggctgtgctagagcagattggcctctgttttcccaaccgcctcccacagctgatgctgcagagcctgagcacctctgaggagctgcagcgccagttccacctcttccagctccagcggctcgacaagttgttcttggagcaggaagatgaggaggaaaagagactagaggaagaggaggaggaagaggaggaagaggaagctgagaaagaattatttatcgaagatccaagtccagccatttctatactggtcctgtcaccacgctgctggcccgtctccccactctgctacctgtaccatcccagaaagtgccttcccacagaattctgtgatgcccttgaccgtttctccagtttctacagccagagtcagaaccatccagtcctggacatgggaccacatcggcgactgcagtggacgtggctgggccgggctgagctgcagtttgggaagcagatactgcatgtgtccaccgtgcagatgtggctgctgctgaaattcaatcagacagaggaggtgtcagtagagaccttgctgaaggattctgacctctccccagagctgctgctccaggcactcgtgcccctcacctcagggaatggccctttgaccctgcatgagggccaggactttccacacgggggtgtgctgcggcttcatgagcctgggccccagcgcagtggggaggccctgtggctgatacctccccaggcatacctgaacgtagagaaggatgaaggccgaaccctggaacagaagaggaatctcttgagctgtcttcttgttcgtattctcaaagcccatggggaaaagggcctccacattgatcagctggtttgtctggtgctggaggcctggcagaagggtccaaatcctcctggaaccctgggccacactgttgctgggggtgtggcctgtaccagtacagatgtcctctcttgcatcctgcacctcttaggccagggctacgtgaaacggcgtgatgaccggccccagatcctgatgtatgccgctccagagcccatggggccctgccggggtcaggcagatgtccctttctgtggcagccagagcgaaacctccaagcccagcccagaagctgtggctaccctggcatctctacagctgcctgcaggccgcaccatgagcccccaggaagtagaagggttgatgaagcagacggtgcgtcaggtgcaggagacgctgaacttagagccagatgtcgctcagcaccttttggctcattcccactggggcgctgaacagctgctgcagagctacagtgaggaccctgagccactgctgctggcagctgggctgtgcgtacaccaggctcaggctgtacccgtacggcctgaccactgccccgtctgtgtgagccccctggggtgtgacgacgacctgccctctctctgctgcatgcactattgctgtaagtcttgctggaatgagtacctgacaactcggatcgagcagaaccttgttttgaattgcacctgccccattgccgactgccccgcccagcccaccggagccttcattcgtgccatcgtctcctcgccagaggtcatctccaagtatgagaaggcgctcctgcgtggctatgtggagagctgctccaacctgacctggtgcaccaacccccagggctgcgaccgcatcctgtgccgccagggcctgggctgtgggaccacctgctccaagtgtggctgggcctcttgcttcaactgtagcttccctgaggcacactaccctgctagctgtggccatatgtctcagtgggtcgacgacggtggctactatgacggcatgagcgtggaggcgcagagcaagcacctggccaagctcatctccaagcgctgtcccagctgtcaggctcccatcgagaagaacgaggggtgcctgcacatgacctgtgccaaatgtaaccatggattctgctggcgctgcctcaagtcctggaagccaaatcacaaagactattacaactgctctgccatggtaagcaaggcagctcgccaggagaagcggtttcaggactataatgagaggtgcactttccatcaccaggcgcgggagtttgctgtgaacttgcggaaccgggtgtctgccatccatgaagtgcccccgcccagatccttcaccttcctcaatgatgcctgccagggactggagcaggctcggaaggtgctggcctacgcctgcgtgtacagcttctacagccaggacgcagagtacatggatgtggtggagcagcagacagagaacctggagctgcacaccaatgccctgcagatcctcctggaggaaaccctgctgcggtgcagagacctggcctcctccctgcgcctcctgcgggccgactgcctcagcacgggcatggagctgctccggcggatccaggagaggctgcttgccatcctgcagcattctgcccaggatttccgggttggtcttcagagtccatcagtagaggcctgggaggcaaaaggacccaacatgcctggcagtcagccccaggcctcctcagggccagaggcagaagaggaggaggaagacgatgaggatgatgtgcccgagtggcagcaggatgagtttgatgaggagctggacaatgacagcttctcctacgatgagtctgagaacctatgactgagggggcagatgcaggaaacacctagagcagccccagagtcacggggctgagggggcgggagctgcccctgtcatagggagggggattcccagcgtctgtagtgcttcctgtttgctgaataaaggtctctttctcacacacaaaaaaaaaa

SEQ ID NO: 435334 - DNA, 1345 bp, Homo sapiens
ccaggctgaatggtgggagctgcttttctttatcaaaaagttggacttgtgtgagcagcagccaattttccagaatctttggaagaacctggatgagaccctgggtgaaaaggccctaggtgagatctctgtgtccgtggaaatggccgagagtctgctgcaggttctcagtagtcgatttgagggcagcactctcaatgacctgctcaactcccagatctacaccaagtatgggctgctgtctaatgaaccaagcagctcgtctacttcacgaaatcactcctgtaccccagatccagaagaggagtccaagtcggaggccagcttctcagaggaagagactgagtccctcaaagcaaaggccgaggcccctaagacagaggccgagcccaccaagacaaggaccgagacccccatggcacagagtgattctcagctgtttaaccagcttctggtgactgaggggatgaccctgcccactgagatgaaggaggcagccagtgaaatggccagagccttgcggggtcccggtcctcgcagctccctggatcagcatgtggcagcggtcgtggccactgtgcagatatccagcttggacacaaacctgcagctttcagggctctctgccctctctcaggctgtggaggaggtcactgagcgggaccaccctctggtccgtcctgacagatcgctgagagagaagctagtgaagatgctggtggagctgctgaccaaccaggtgggagagaagatggtggtcgtgcaggccctgcgcctcctttacctgctcatgaccaagcacgagtggcggccgctctttgccagggagggtggcatctatgctgtgctggtctgcatgcaagaatataagacttctgtcttggtgcagcaggctgggctggcggcactgaagatgctggccgtcgccagctcctcggagatccccacttttgttactggccgagattctatccactctttgtttgatgctcagatgaccagagagatcttcgccagcatcgactcagccacacgcccgggctctgagagcctgctcctcactgtccctgcagccgtgatcctgatgctgaatactgaggggtcagggcattaccttcccaactccaggctcctgcttagtcccaaaccctgctactcctgtgctccaggctcatgtactccacagaaattcccctcacgctgtcacctccggattaagcattggtggcgctgccaactgttgttggaggagaacccaagtggattggggatagggagattcccagagagggcagagacacactgacttccctttatgggtttgggaggagtggcccaaggtcag

SEQ ID NO: 435335 - DNA, 544 bp, Homo sapiens
aaaggccccatgccctctacctccttctcaaatccttctgtctgctcaccaggatttccgggttggtcttcagagtccatcagtagaggcctgggaggcaaaaggacccaacatgcctggcagtcagtaagtggggtgggcagagccatggaggaggcagtgggacatggcagcctcctctgggctgagtgtggtggctctccctaggccccaggcctcctcagggccagaggcagaagaggaggaggaagacgatgaggatgatgtgcccgagtggcagcaggatgagtttgatgaggagctggacaatgacagcttctcctacgatgagtctgagaacctggaccaagagactttcttctttggtgatgaggaagaggatgaagatgaggcctatgactgagggggcagatgcaggaaacacctagagcagccccagagtcacggggctgagggggcgggagctgcccctgtcatagggagggggattcccagcgtctgtagtgcttcctgtttgctgaataaaggtctctttctcacacac

SEQ ID NO: 435336 - DNA, 212 bp, Homo sapiens
ggtggagctgctgaccaaccaggtgggagagaagatggtggtcgtgcaggccctgcgcctcctttacctgctcatgaccaagcacgagtggcggccgctctttgccagggagggtggcatctatgctgtgctggtctgcatgcaagaatataagacttctgtcttggtgcagcaggctgggctggcggtgagtacattgggcctggcgggag

SEQ ID NO: 435337 - DNA, 305 bp, Homo sapiens
aggtctaagtccttctaaaggtttctttaaaggtttttaaacaaaatgctaaacctaaaaacattgtcctgtcagttcccaaattaaatcgacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgta

SEQ ID NO: 435338 - DNA, 1834 bp, Homo sapiens
agcggaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgta

SEQ ID NO: 435339 - DNA, 1894 bp, Homo sapiens
agcggaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgtacctttgtatatgtttgtttgcttttctttaactttcagataaatattgaatttagcatag

SEQ ID NO: 435340 - DNA, 1272 bp, Homo sapiens
  misc_feature (1169)..(1169): n is a, c, g, or t
  misc_feature (1172)..(1172): n is a, c, g, or t
agcggaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaagctctctgaagaagagattctggaaaacccggacttgtttctcaccagtgaagccacagattatggcagacagctccatgatgactatttctatcatgatgagctttaatccgagctgttcaaaanaangggccttttaattgggccccctcctttcggggccaactctcgcgggttgtcacctcagtttacccgagatttttggagaaaactggggttggaacacaat

SEQ ID NO: 435341 - DNA, 1888 bp, Homo sapiens
agcggaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaaggaatttgccatttgtaaaaaacagtctttctgtttttggcttcttcgatttaatcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgta

SEQ ID NO: 435342 - DNA, 1924 bp, Homo sapiens
agcggaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcatcaatgtggaggtttggggctccatcctcagagccagtctgcttagcttcacatttagctccagcacttcacggttgtgtaactttggcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgta

SEQ ID NO: 435343 - DNA, 1183 bp, Homo sapiens
agcggaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaagtaagtcacctgggagaatgtgaaaagagaaaaggaattgaagaaagacattgaaagacagccttgctcattgaaagctctcttcaacaggaaatgtaatgaggatctgtgtctgatcctacttgtttcgttaactgtaatacaagttcaacaaatggatttatagcttatctgagaacgctgtcttgcttacttttacttccgtgtctagagtcaaacatttttctttcttttcaaacaaatctaattttattatcagtttaaatggggaaggaagtaaggtagatatttttaaacaaaatcctgtgctgttgcaggtggatctt

SEQ ID NO: 435344 - DNA, 1417 bp, Homo sapiens
gttgcttaaagacaccaaacaatgccatttttaaattggtcaccagttttacttattctgattgtcactttaaaattacacatggcattactttgtgaaaacatgtaagaaactttgtatagaaacatgatatacagtaaaacattacccacctcacatctgggaaaactagatatcggaacaaatagcagttaacaaaattactagtttgtgaaaacatccaatgattttaaaactgggttgtttagactcgtgtcacttttgaaaatgactatatatttgttcttatgtcaggacttttcagttaagtagttctgttttattgggctttctttagtaaactttaaattcacttcctttattctagggatataccaaacttcttattggatacatgtgatattcttgtgtatgtatatttgtgtttttttatattaagcctgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgta

SEQ ID NO: 435345 - DNA, 987 bp, Homo sapiens
cggaccgttgtactggcttgtgggagaagtgtacgaatgggtatgagaagtcagatttaggatatattgtgtatacataacgatggcaggcttgatccccaagagctgttaccttgggtagtacctaataatcagggcattgcacaagaggaggcgcttcatctaattgatgaaatggatttgaatggtgacaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgta

SEQ ID NO: 435346 - DNA, 503 bp, Homo sapiens
  misc_feature (8)..(8): n is a, c, g, or t
  misc_feature (13)..(13): n is a, c, g, or t
  misc_feature (15)..(16): n is a, c, g, or t
  misc_feature (31)..(32): n is a, c, g, or t
  misc_feature (34)..(34): n is a, c, g, or t
  misc_feature (44)..(44): n is a, c, g, or t
  misc_feature (50)..(50): n is a, c, g, or t
  misc_feature (58)..(58): n is a, c, g, or t
tttctttncgttntnntgccaccattttttnntnttgtcccctntccccncccccccncccctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgta

SEQ ID NO: 435347 - DNA, 1355 bp, Homo sapiens
agcggaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaaggtcttaatgcatatgggaaagttttgaccacttttagtcaagagaaaagcagctactttatcctcgttgtatgtggtgcttgctctccgatttataactcttccactatataggatggacgggcgaaagcgaatttgataaaggctaagccaggattcaggtcccggttggatgctctttgaagaatgtcattcgctttgtgagcatcctgaagaacgttgcaatgtatatgacggtcactttagtcattcaagaaggctttcagtaagacactatgacaaaaatggtgcatggcatttgcttaccttttggaacgaaatttcttgcggtgattcacagggtgcggatcccaactgcccacaatgagaagcctgcaaatgaagatccagaatggatacttgttgagaaagacagattcgtgaatgattatgacaaagataacgatggcaggcttgatccccaagagctgttaccttgggtagtacctaataatcagggcattgcacaagaggaggaggcgctttcatctaagttgaatgcaacatgggatttgaagttggttgacaaaacatatgcgtctactgacacgcaaagagcattctgggaacaaaccccggaacttgtttacttccacccagttgaaaggcccacacggatttattgcgcgcagaacacgctccattgtatgactacttttcctaatccatga

SEQ ID NO: 435348 - DNA, 834 bp, Homo sapiens
tattagagatttttatcccagtttgatagatgaggaaaccagagaggttaagcagtttgcgctgacaccacagctagtaagtggcattgctggaattcaggtctgggtctatatgactctagagcttgtgagtctatcctgcccctaatacatgtatttgtgtagcttaccttcaaagggacgatgtgaagataaatgagataacggatgggaatgtactttaaatttcacatagtttgtatttttcaaagtatttaaaatgatgtggtatactaatgagaaattttaattttcaaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaagtaagtcacctgggagaatgtgaaaagagaaaaggaattgaagaaagacattgaaagacagccttgctcattgaaagctctcttcaacaggaaatgtaatgaggatctgtgtctgatcctacttgtttcgttaactgtaatacaagttcaacaaatggatttatagcttatctgagaacgctgtcttgcttacttttacttccgtgtctagagtcaaacatttttctttcttttcaaacaaatctaattttattatcagtttaaatggggaaggaagtaaggtagatatttttaaactgataataaaattagatttgtttgaaaa

SEQ ID NO: 435349 - DNA, 573 bp, Homo sapiens
gtagtagaattgaatcggatggcagtgggactgaacattttgtaacttttttttttcttttttaatgaacgtggaataggaatttgtcattcaagaagctttagaagaacatgacaaaaatggtgatggatttgttagtttggaagaatttcttggtgattacaggtgggatccaagtaagtcacctgggagaatgtgaaaagagaaaaggaattgaagaaagacattgaaagacagccttgctcattgaaagctctcttcaacaggaaatgtaatgaggatctgtgtctgatcctacttgtttcgttaactgtaatacaagttcaacaaatggatttatagcttatctgagaacgctgtcttgcttacttttacttccgtgtctagagtcaaacatttttctttcttttcaaacaaatctaattttattatcagtttaaatggggaaggaagtaaggtagatatttttaaacaaaatcctgtgctgttgcaggtggatcttaaaagagatagaaacataaaacactacaaatactggtgtaaacacagtatcagaagcttagtagaaggtga

SEQ ID NO: 435350 - DNA, 1873 bp, Homo sapiens
agcggaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgtaaaaaaaaaagtcgacgcggccgcgaatttagtagtagta

SEQ ID NO: 435351 - DNA, 1855 bp, Homo sapiens
agcggaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgtactttaaaaggaggaaaaaaaa

SEQ ID NO: 435352 - DNA, 1182 bp, Homo sapiens
agcggaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaagtaagtcacctgggagaatgtgaaaagagaaaaggaattgaagaaagacattgaaagacagccttgctcattgaaagctctcttcaacaggaaatgtaatgaggatctgtgtctgatcctacttgtttcgttaactgtaatacaagttcaacaaatggatttatagcttatctgagaacgctgtcttgcttacttttacttccgtgtctagagtcaaacatttttctttcttttcaaacaaatctaattttattatcagtttaaatggggaaggaagtaaggtagatatttttaaactgataataaaattagatttgtttgaaaa

SEQ ID NO: 435353 - DNA, 1492 bp, Homo sapiens
agtagtgttaagtacattcacagtgttgtgcagctaatccccagaactcttttcatcttggaaagctgaaactctgtacctgttaaacaacaccccattccctccttggtaaatgctttctaagtgtgctatttatttagaatcatattggccgcttgaactctgtaagccaccactaactctaagttggttaattctctgctaataactacagcatcaatgtggaggtttggggctccatcctcagagccagtctgcttagcttcacatttagctccagcacttcacggttgtgtaactttggcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgta

SEQ ID NO: 435354 - DNA, 764 bp, Homo sapiens
  misc_feature (153)..(154): n is a, c, g, or t
ccctaagctgtattcccattgcccctagtcatccactccctaccatggtcggggcttccagcgtgcgcatggcccgctgcggggcagggtggccggcgcggcgccggggcgggctcccggagccgtgtgttaggcccgcggttcggatctctnngacacgcgggcccctgcgctaccgtggtgagactcacggccctgagcggatcggtaccctcagctttcccaaacgctccagaagttagtctttgacccacaggcttacaggaccatctcggctggcgcatcgccccctgcccctaattccttaggccttaccaccaagctttttccacacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatctggctactacaaagttctgggaaagggaaagctcccaaagcaggctgtcaccgtgcaggccaaattcttcagcagaagagctgaggagaagattaagagtgttgggggggcct

SEQ ID NO: 435355 - DNA, 458 bp, Homo sapiens
agttttttttttcgtctgggctgccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatctggctactacaaagttctgggaaagggaaagctcccaaagcaggctgtcaccgtgcaggccaaattcttcagcagaagagctgaggagaagattaagagtgttgggggggcct

SEQ ID NO: 435356 - DNA, 420 bp, Homo sapiens
gacatatcaggctacattgggaaagttggtatgaagcattaccacttaaagaggaaccagagcttctgcccaactgtcaaccttgacaaattgtggacttggtcggtgaacagacacgggcaacttcgacggaccattcaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatctggctactacaaagttctgggaaagggaaagctcccaaagcaggctgtcaccgtgcaggccaaattcttcagcagaagagctgaggagaagattaagagtgttgggggggcct

SEQ ID NO: 435357 - DNA, 2783 bp, Homo sapiens
caggcgcgttaagctggttgggacccgggaaggcctccctcttaaggtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagaggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaaatgtcag

SEQ ID NO: 435358 - DNA, 558 bp, Homo sapiens
tctgtctctactaaaaatacaaaaattagctgggcgtagtcttggacgcctgtaatcccagctactcgggaggctaaggcaggagaatcgcttgaaccctggaggcggaggttgcagtgagctgagatcgcaccactgcactccagcttgggtgaaagaaagactccgtttaaaaaaaaaaacaaaaaaacaaaagaaagtgtaatgcatgaagtgaaatgaaaaatagatgctgggaaggatgtctaactgggagatagcttgtgatgtaaatatgtaaatatattatgaatgaccagtgggcaaggcaaaattgcctacacagccctacctatggcccctctgaaaatgttctttcttcagcagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccaaaacaagaccacacgccaaacaagaagggtgctctagata

SEQ ID NO: 435359 - DNA, 615 bp, Homo sapiens
  misc_feature (58)..(58): n is a, c, g, or t
gcaggctgggtctgcagatggcgtccgagtgtacagtggccagtgtgattccgcagtnttgggctgttcggccaagcgcccaccggacgtgggacgctggagggtcagcagcgtggagtcctggccttcagcgtccgcggctgggaaatcggccatcgccacggcgggaactaggactggctgcgtcccggcccttccccatccgtccaccggactcgtgggcgcccgcactgactgtgatgtagtttcctgacctctgacacgtattgtctcaagattaaaggaatcaggagcttcttttgctgttcttctgttttggatgcattggaaggtccagatttggaacaagtctctctagagattgaacagagctgcgcctggaacccgccgcagggaggagacctgaagaccagaggaaacacagcaactggcaagcagatgaattaactcccccaagcttctagctgtgtttctactcagtgggagagatttggagtgaatcatgagggtcaaccacacagtgtctacaatgctccctacatgcatggttcacagacaaaccatgagttgttccggggctggaggaataacggttgtattaaatgtgttaaagta

SEQ ID NO: 435360 - DNA, 3336 bp, Homo sapiens
ctctacagtgtcagcctcatccaggctggttcccctcaaagccataggatgtctgccaatagcaactttgtttaattctcacaatggccccataaggtaagtactattataatatcgattttataggaaattgagacacagatattaagatatcaacgcaaagtcataggggagggaggagagaggggactgtaatttgaacacagtttgtctccagagtttgtgcttttagccactgagtagttgttaaactttagtgtgcatcagaattacttggaagccttgttcaaacattgctgggctccccccgcaatttctgattcagtagccctaggatggggactgagaatttttatttctaacaagttcccaggggatgctggtgctgcaggttcagggaacacacattgagccagtgcactaagccctgctgcctcttttgggtaatctgtgcccatgtttctgagcatcaggaaaagtgcttaattcctgtgactccatcttacaaatgacgaagtcttttgctagaatcctacggtaaggcttcttgtggcctgttggttaccattcatttttcatatatttatttttcagctggcaagcagatgaattaactcccccaagcttctagctgtgtttctactcagtgggagagatttggagtgaatcatgagggtcaaccacacagtgtctacaatgctccctacatgcatggttcacagacaaaccatgagttgttccggggctggaggaataacggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaaatgtcag

SEQ ID NO: 435361 - DNA, 2948 bp, Homo sapiens
caggcgcgttaagctggttgggacccgggaaggcctccctcttaaggtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagagctggcaagcagatgaattaactcccccaagcttctagctgtgtttctactcagtgggagagatttggagtgaatcatgagggtcaaccacacagtgtctacaatgctccctacatgcatggttcacagacaaaccatgagttgttccggggctggaggaataacggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaaatgtcag

SEQ ID NO: 435362 - DNA, 2886 bp, Homo sapiens
gagacagagttttgctcttgttgcccaggctggagtgcaatggcgcaatctcggcttaccgcaagtaactgggattacaggcatgcgccaccacacctgactaattttgtatttttagtagagacggggtttctccatattggtcaggctgatctcaaactctcgacctcaggtgatccgcccaccttggcctcccaaagtgctgggattacaggcatgaaccaccgggcctggccttgacctctcattctaaagtgtgggagggaaagacaggctcctgggtgagcagaggtgtgttttgtgttaaaggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaaatgtcag

SEQ ID NO: 435363 - DNA, 3120 bp, Homo sapiens
caggcgcgttaagctggttgggacccgggaaggcctccctcttaaggtctttcccacacctctgcaccttgttacctgactttcggcttcaggatccgcagcgtgcacccgcgttccgtgagtgccctataggcagtcagcatgcccctctgcgtgtccctgtgttacggggacgccggctgggagccgcagagctatctcagaactagggcgctctcctttgggcacctccaggccattttcctttcattcgagcccacagggttagagataaaccctcactccgttgcttggggacaagggcttcactccctgtcccgagcttgcggctgagcttgagggtggctgggtcatcctggccccccactggatgggaattggctgctctggtgatttctgtgacatcccagaccccaactgtggggctctggagcggactgcgcttcacttcgtggggagggtgtttccacctaggccactcttatttctcttcacatccccagatctgtcttctgagactttgcccttctccaggaagagcactcaggagaccaggaaaatggccacagggctcctgagagccaaaaaagagaaattccatcttctaaaccaaaactcattgctcagctggagcgaggggaagcgccctggagagaggagagaaaatgtccactggacctctgtccagggggaatggtttcagctttcgcccattcagtatgaagttggctgtaggtctgtcacagataactcttcttattttgagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaaatgtcag

SEQ ID NO: 435364 - DNA, 2720 bp, Homo sapiens
tctgtctctactaaaaatacaaaaattagctgggcgtagtcttggacgcctgtaatcccagctactcgggaggctaaggcaggagaatcgcttgaaccctggaggcggaggttgcagtgagctgagatcgcaccactgcactccagcttgggtgaaagaaagactccgtttaaaaaaaaaaacaaaaaaacaaaagaaagtgtaatgcatgaagtgaaatgaaaaatagatgctgggaaggatgtctaactgggagatagcttgtgatgtaaatatgtaaatatattatgaatgaccagtgggcaaggcaaaattgcctacacagccctacctatggcccctctgaaaatgttctttcttcagcagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaaatgtcag

SEQ ID NO: 435365 - DNA, 1742 bp, Homo sapiens
cacaccacctgagtctgtcctctggtgtgttttgaggtttgatttccagctaaagtgacgcccacagttctgtgcatacataaggcttctctcctgtgtgtgtccttaagtgtctgatgaggtgtgacttctggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaaatgtcag

SEQ ID NO: 435366 - DNA, 2913 bp, Homo sapiens
  misc_feature (58)..(58): n is a, c, g, or t
gcaggctgggtctgcagatggcgtccgagtgtacagtggccagtgtgattccgcagtnttgggctgttcggccaagcgcccaccggacgtgggacgctggagggtcagcagcgtggagtcctggccttcagcgtccgcggctgggaaatcggccatcgccacggcgggaactaggactggctgcgtcccggcccttccccatccgtccaccggactcgtgggcgcccgcactgactgtgatgtagtttcctgacctctgacacgtattgtctcaagattaaaggaatcaggagcttcttttgctgttcttctgttttggatgcattggaaggtccagatttggaacaagtctctctagagattgaacagagctgcgcctggaacccgccgcagggaggagacctgaagaccagaggaaacacagcaagcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagaccacgacacagaccacgacacaatgcaccactgacacatggcacggac

SEQ ID NO: 435367 - DNA, 1263 bp, Homo sapiens
ctctacagtgtcagcctcatccaggctggttcccctcaaagccataggatgtctgccaatagcaactttgtttaattctcacaatggccccataaggtaagtactattataatatcgattttataggaaattgagacacagatattaagatatcaacgcaaagtcataggggagggaggagagaggggactgtaatttgaacacagtttgtctccagagtttgtgcttttagccactgagtagttgttaaactttagtgtgcatcagaattacttggaagccttgttcaaacattgctgggctccccccgcaatttctgattcagtagccctaggatggggactgagaatttttatttctaacaagttcccaggggatgctggtgctgcaggttcagggaacacacattgagccagtgcactaagccctgctgcctcttttgggtaatctgtgcccatgtttctgagcatcaggaaaagtgcttaattcctgtgactccatcttacaaatgacgaagtcttttgctagaatcctacggtaaggcttcttgtggcctgttggttaccattcatttttcatatatttatttttcagctggcaagcagatgaattaactcccccaagcttctagctgtgtttctactcagtgggagagatttggagtgaatcatgagggtcaaccacacagtgtctacaatgctccctacatgcatggttcacagacaaaccatgagttgttccggggctggaggaataacggcgttcgtggcattcagggatgtggctgtgtacttcacccaggaggagtggaggttgttgagccctgctcagaggaccctgcacagggaggtgatgctggagacttataaccatctggtctcactgggtaagaatggcctcccttggcacttaaaatctgccctacagagtattttccactcatcgtgaggaagggctacctgcagagcacctttcccttagagttgagcttgaaaacaatttacttttttcctctgggtaaatctggatttagtagaattgaaagcagacagattgatttattcatgttatggatgacactacatttccaggcctgtttcccaaggcttgtgctctctctttattttgcttcaaacccaggaaatttttcatacaccaagtgttcataatatgccatctttctgactggagtcacctttccttagtcaacccttctacttcagagagagaactattcataggtcttttttatcctctgggttt

SEQ ID NO: 435368 - DNA, 159 bp, Homo sapiens
cgccctggagagaggagagaaaatgtccactggacctctgtccaggtgagtgttgagtgtggggtagacgggataatccacagcttggcagataggaaggaggaggcatctctcagatactgggaagaagctcttcttcaggcctcctaagccaagaga

SEQ ID NO: 435369 - DNA, 779 bp, Homo sapiens
caggcgcgttaagctggttgggacccgggaaggcctccctcttaaggtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagaggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagatggagccttgctctgttgccaggctggaatacagtggtgttatatcggctcactgcaacctctgcctcctgggttcaagcaattcccctgcctcagcctcctgagtagctgggactacaggtgcacaccaccacacctggctaattttttgtattttagtagagacggggtttcaccatgttggccaggatggtctcaatctcctgaccttgtgatccacccgcctcagcctcccaaagtgctgggattacaggcatgagccaccatgcctggcccttttcattgtttattaaccatttgcatatcttttttagtaaaatgcctattcaattctttctttattttaaaa

SEQ ID NO: 435370 - DNA, 3004 bp, Homo sapiens
  misc_feature (58)..(58): n is a, c, g, or t
gcaggctgggtctgcagatggcgtccgagtgtacagtggccagtgtgattccgcagtnttgggctgttcggccaagcgcccaccggacgtgggacgctggagggtcagcagcgtggagtcctggccttcagcgtccgcggctgggaaatcggccatcgccacggcgggaactaggactggctgcgtcccggcccttccccatccgtccaccggactcgtgggcgcccgcactgactgtgatgtagtttcctgacctctgacacgtattgtctcaagattaaaggaatcaggagcttcttttgctgttcttctgttttggatgcattggaaggtccagatttggaacaagtctctctagagattgaacagagctgcgcctggaacccgccgcagggaggagacctgaagaccagaggaaacacagcaagcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaaatgtcag

SEQ ID NO: 435371 - DNA, 3107 bp, Homo sapiens
cacctctgacgagttccactgatcaacactgttgcgttaggggttgagtttccaacacatgaactttggggaacacattcaaaccacagcagtcctcatgtaaaccttccagaaaatctgtgtgcctggcactctggaatccctcttttccaccctttctctttttttttttttttgagatgaagtttcactcttgttgcccaggctggagtgcaatggagcgatatcggctcactgcaacctccacctcccaggttcaagcaattctcctgcctcagcctcccgagtagctgggattacaggcatgcgccaccacacctgggtaattttgtatttttagtagagacggggtttctccatgttggtcaggctggtctcgaatctcgacctcaggtgatccgcccaccttggcctcccaaagtgctgggattacaggcatgaaccaccgggcctggccttgacctctcattctaaagtgtgggagggaaagacaggctcctgggtgagcagaggtgtgttttgtgttaaaggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaaatgtcag

SEQ ID NO: 435372 - DNA, 3414 bp, Homo sapiens
ctctacagtgtcagcctcatccaggctggttcccctcaaagccataggatgtctgccaatagcaactttgtttaattctcacaatggccccataaggtaagtactattataatatcgattttataggaaattgagacacagatattaagatatcaacgcaaagtcataggggagggaggagagaggggactgtaatttgaacacagtttgtctccagagtttgtgcttttagccactgagtagttgttaaactttagtgtgcatcagaattacttggaagccttgttcaaacattgctgggctccccccgcaatttctgattcagtagccctaggatggggactgagaatttttatttctaacaagttcccaggggatgctggtgctgcaggttcagggaacacacattgagccagtgcactaagccctgctgcctcttttgggtaatctgtgcccatgtttctgagcatcaggaaaagtgcttaattcctgtgactccatcttacaaatgacgaagtcttttgctagaatcctacggtaaggcttcttgtggcctgttggttaccattcatttttcatatatttatttttcagctggcaagcagatgaattaactcccccaagcttctagctgtgtttctactcagtgggagagatttggagtgaatcatgagggtcaaccacacagtgtctacaatgctccctacatgcatggttcacagacaaaccatgagttgttccggggctggaggaataacggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagggggaatggtttcagctttcgcccattcagtatgaagttggctgtaggtctgtcacagataactcttcttattttgagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaaatgtcag

SEQ ID NO: 435373 - DNA, 2656 bp, Homo sapiens
caggcgcgttaagctggttgggacccgggaaggcctccctcttaaggtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagagaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaaatgtcag

SEQ ID NO: 435374 - DNA, 2479 bp, Homo sapiens
tgagatgaagtctcactctgttgcctaggctggagtgcagtggcgcgatctcggctcactgcaacctccacctcctggtttcaagcagttctctgcctcagcctcccgattagctgggactacagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaaatgtcag

SEQ ID NO: 435375 - DNA, 1416 bp, Homo sapiens
ctaaattaaggctattaacacttttcatgaaatataggatacaaacttgttttaactttttcatttgattttttaacagtgttaaatttttctgagtgttaagtacagaaattgtttccctttatgatttttccattgtttttatgcttaggaaggccttgcccatctcaagataagttaactttcacttagattttaaaaatactaactgccctttgagtttaatgttttttagaactgttattcttgaatcaatatgtaatttatttgggcatatgatactgaggatagttcgatttaagatctgcccaaatagcgagttatctcgatgctgtgtcaacagggacattgtcagtttctctgagagaaatctttgtgccccgcccttctgtgggagtgccacttattgtatccacttgggcacagcatggagaatgtcttaaatgcaccagataagtctgaaacagactgttgctttgcaccattgagtcaaaaataagcctactaaattataagtgacagaatgtgaaaagcagaattgtgggaatcatatactgtgcctctaaaaaatactttatcaatgactttgtcttacagttcccagggagacaggtgatttttttgttttctgattcccatcatttatgcttcttctgaacaatttgtggtgcatctgcatcaaagttaaatcagctgctatttaccttctgcaagtgctttatataagacatggaagaaaaaaattcagtgaccagagagagatagaaatgtacagggcagaattatttggagtcagctttttggaaagtattgctttgttggaggaaaaataaggcagctatcctgctggtctgggatgctttgcaacacaagtcatcttttgaatatcatagggttgtccttggtttcccatggagcaaatgaataaaatcagatggtaaattggtgtgaattattcatcatgtggtaatacaaggctgtaattcctacctctgacaattgcggcctgtgtcagttccattgtttgtgttattgtactttatgcaccctccagaattatctaccccctccccagtgtaaaccattggttggaacattctgcttcttagaaggcagcagttttgtcttctgcctcttttaacatattctgtctcttaggtctgaattctgaatagaaatcagaactttttcactcccttatgaagcatgttagtgggggatgcttaccttccttaatgaaacttgagacatgcagtcttctttgatttccatatatgattaataaatgttacattcataacaatttttctctcttattttcattaacagaaaaatagcaaaatgactgcagctcagaaggctttggctaaagttgacaagagtggaatgaaaagtattgataccttttttggggta

SEQ ID NO: 435376 - DNA, 1736 bp, Homo sapiens
ctaaattaaggctattaacacttttcatgaaatataggatacaaacttgttttaactttttcatttgattttttaacagtgttaaatttttctgagtgttaagtacagaaattgtttccctttatgatttttccattgtttttatgcttaggaaggccttgcccatctcaagataagttaactttcacttagattttaaaaatactaactgccctttgagtttaatgttttttagaactgttattcttgaatcaatatgtaatttatttgggcatatgatactgaggatagttcgatttaagatctgcccaaatagcgagttatctcgatgctgtgtcaacagggacattgtcagtttctctgagagaaatctttgtgccccgcccttctgtgggagtgccacttattgtatccacttgggcacagcatggagaatgtcttaaatgcaccagataagtctgaaacagactgttgctttgcaccattgagtcaaaaataagcctactaaattataagtgacagaatgtgaaaagcagaattgtgggaatcatatactgtgcctctaaaaaatactttatcaatgactttgtcttacagttcccagggagacaggtgatttttttgttttctgattcccatcatttatgcttcttctgaacaatttgtggtgcatctgcatcaaagttaaatcagctgctatttaccttctgcaagtgctttatataagacatggaagaaaaaaattcagtgaccagagagagatagaaatgtacagggcagaattatttggagtcagctttttggaaagtattgctttgttggaggaaaaataaggcagctatcctgctggtctgggatgctttgcaacacaagtcatcttttgaatatcatagggttgtccttggtttcccatggagcaaatgaataaaatcagatggtaaattggtgtgaattattcatcatgtggtaatacaaggctgtaattcctacctctgacaattgcggcctgtgtcagttccattgtttgtgttattgtactttatgcaccctccagaattatctaccccctccccagtgtaaaccattggttggaacattctgcttcttagaaggcagcagttttgtcttctgcctcttttaacatattctgtctcttaggtctgaattctgaatagaaatcagaactttttcactcccttatgaagcatgttagtgggggatgcttaccttccttaatgaaacttgagacatgcagtcttctttgatttccatatatgattaataaatgttacattcataacaatttttctctcttattttcattaacagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgtt

SEQ ID NO: 435377 - DNA, 1299 bp, Homo sapiens
agaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggta

SEQ ID NO: 435378 - DNA, 3035 bp, Homo sapiens
  misc_feature (1239)..(1239): n is a, c, g, or t
agaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagctcctctgcagctggtatgtttatctcctagatccagagaatggagaagccaatcataaaccacacctgactgcaaattgcagcgttccttcagcccaggccagatcncagatgagttaaactctgctccaagacagggaaataaacatgtgcaccagcttgtcagtgaggtcatttcttcagccagcaaagtaacggatgccttgagaatgtaaaatggacatattgtggatgttacaaactttccttctcccttgcattgttttcttggccttcaaggtagctaaaatgctcataattttttatgtcattccctgtataaaggtggtggtggctccaaagacattgtccttagaaaaggacagaaaattgaaagtacagcagtgtttgtttgggcctatgttcagcatgttgtcaaaaaaaaatgcatgttttactctcttggagaatagcactgggcagaagtctgttgctgtaagatctaaggactgctctaggccagacccatgcgtctttcattccggtagttaatctctgacagtagctctagaggacctagagaggcacagttgtcttgctgaaactaagagggtaggttctcagcgtgcttcttatttttcttcatccaaaaatgaagcagatttttttctcccaaatatctatcttccttagtaacttagagatcattcatgaattgatctaaacctattcttgaaagctttaaccttggataccttttggagtaatatgtttcataactttattcttctctgctcctgatttctgttttcttattttaattttcagaatttaagttgtttgtgacttcatcatttatgatttagatcagagatcagcaaaccttttcttctaaagccagacagtaaatattttaggctccatgaagcagatggactctattgcagctactcaactctgctgttgtattgtgaaaacagccacagataatacataaacgaatgagcatggctgtgttccagtaaaacttcatttataaaagcaggcagccagctggatttggcccctgggccatcatttgccaagccctgattttgattttggcatcttgctcttcctaaaccccagccttgtcttctatattatttgagttgcttttcgaggtcttctactctgtgtctttctggggttccagtgtacacatgacaaactatactagacgatgtaccatcgtttaaacaagcgtagaacatatcttctgctagctttcctgtctgtatccaggatttgattgatttttacagtaatatagttgactgtttccaggaaatatattccagtagtcattaggtatctttgtatctatgttgtaatcgatagcgtggagcctgtcatctttaatatgttttatattattttcctttactatcatatgtctgcctttgttgaaactcagcttccaaccctcacttgctccagtcttttcaatttgtcactgtcagcaagcagagttgaatgcaaccagtgggtttggagatgttcccgagttccttcttgcaaatcatttgtaagaaggcctaacattatccctgtggtactctgcagtttgttctctttccagaactgtatccatttagtcatagcctttgttactgtctttctgagccacttctctgctgaaacaatctcccaaatccatagggatttggtcttttaaataacaaaaattttagtaaatgcttcaatcatctttttttccaatatattcaacagtgcactgggaataacatacaaactagttatatgtagaggctaccacaatcattttctttttttaaacacttgtaactggtatcttgttttgttgtgagctattaaaacacctgaacaagtcatttctccaattaaacattttatgtccatac

SEQ ID NO: 435379 - DNA, 1357 bp, Homo sapiens
agaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaaggtatgtgggttcaggtgtagtggtgtttcgttcatactcagtgcgtgatgtgcatgaatacatgaggaacagttgcacgcttgattgtgattacagttttgaccaggaagaattattaacttgcatttctgtgacttaataatta

SEQ ID NO: 435380 - DNA, 1867 bp, Homo sapiens
  misc_feature (1208)..(1208): n is a, c, g, or t
agaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagatccagagaatggagaagccaatcataaaccacacctgactgcaaattgcagcgttccttcagcccaggccagatcncagatgagttaaactctgctccaagacagggaaataaacatgtgcaccagcttgtcagtgaggtcatttcttcagccagcaaagtaacggatgccttgagaatgtaaaatggacatattgtggatgttacaaactttccttctcccttgcattgttttcttggccttcaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgtt

SEQ ID NO: 435381 - DNA, 1547 bp, Homo sapiens
  misc_feature (1208)..(1208): n is a, c, g, or t
agaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagatccagagaatggagaagccaatcataaaccacacctgactgcaaattgcagcgttccttcagcccaggccagatcncagatgagttaaactctgctccaagacagggaaataaacatgtgcaccagcttgtcagtgaggtcatttcttcagccagcaaagtaacggatgccttgagaatgtaaaatggacatattgtggatgttacaaactttccttctcccttgcattgttttcttggccttcaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggta

SEQ ID NO: 435382 - DNA, 1373 bp, Homo sapiens
agaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgtaaa

SEQ ID NO: 435383 - DNA, 405 bp, Homo sapiens
acttaataattaagaattgcatatgacaatgaaaatgttaagcaactaagacttattattagtcagagaaaaacaatatactacttatcaagagtgtgcctaaattttgctatgtattcatagagtgatagggtgggaaaggagggaggaagctctacaggtaattttttgtcaaccctgctgcccagaagcagaaattatgatgataaaaattaataatttcaccattcagcattcaccctggcaaatggcattttggtaacagtccttacttagttttatacatgcattataaatacatatgtggcctttaacattggcattataatactcagttctgggctttttatttaacattaaattgtgaaaatgttcacatatcattaaacattctttgaaaaaata

SEQ ID NO: 435384 - DNA, 602 bp, Homo sapiens
catcatgtgacagaggaaaaaggtatggtataacttaaaggcttatggctggtagaaaggatggaccttgcctaagaacgtggctgcttacagacacactgaatgtaaggcttattctgtgtccaccatagggaaaactatcattcagatttgctaacactgccagcactgttcctctattgctttggagtgtttagtctttggaactacaaccatggcagtctagggcctacgtccacagggcaggaatcacaaggtgtggcttcagtctcacttcttctttgaactagttctgtgacatcaggcaagtcactcagctgccttctgcctcagatgtctcattgtaaaattacgtaaaacctgtaccttaatagatggaagcatttatcgagcaccttccaaaaagcatatgttgcacattagtgctaagctctagatacttatgaataagacattgtccttttcttcactttgcgcccagtctgatgggggtcaatgacaagctgagcagtgaccgcacagtgtaacggaagtgaactctgaatttactggggatgcacaggacaggtttctaatctggcggggttgggtggggaatgtag

SEQ ID NO: 435385 - DNA, 410 bp, Homo sapiens
gagcctgtaaaaagtaagccctttgctgggtctgctgtcccattcgcctctgtagaggtctaaattatacatgttgggtttttttttaatggattgatgttgtgtcaaagtgacatttgacaccacttcactgctctaatgttgcagaaaataaagttatcagatgagcctgtagaagcaaaagaagattacactaagtttaatactaaagatttgaagactgaaaaggtatgtgggttcaggtgtagtggtgtttcgttcatactcagtgcgtgatgtgcatgaatacatgaggaacagttgcacgcttgattgtgattacagttttgaccaggaagaattattaacttgcatttctgtgacttaataattaagaattgcatatgacaatgaaaatgttaagcaactaa

SEQ ID NO: 435386 - DNA, 1619 bp, Homo sapiens
agaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgtt

SEQ ID NO: 435387 - DNA, 1656 bp, Homo sapiens
agaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagatggcagcacaaagacagaaaaggggcaagtgatggtggtggctccacgcaaggcttggcggttttccctgcaacttcagacactcccagaggactcggactttttcttctgcacttttttggaaaatcgccaggtgccaaaaggtgcattttaaagcgctgactgtaaatgctttatttctttgattagtaccactagtctatgtgggcagcggcattcctccctggagcactcagctaggcggttccgtccaggagcttgaaagcatcccagcggtgcacctgttcagtctgaggacctcaagcttgggtcaggccagcatgttttaggtatggatgtggtgacttaaagtacttgattgtcttgatttcaccctgaaagctttggcaaaccaagtttcaacccttactttaaaaatctgacactgctttactccatatcaatttggaagcttctaattcataaatatacctaaacgttggcattttatctctccaggagttattaaacatttcttccttttt

SEQ ID NO: 435388 - DNA, 2807 bp, Homo sapiens
  misc_feature (1011)..(1011): n is a, c, g, or t
actataggtcggacagtcccgtgtttgaattcggcaaccgaagggggccaagcgccgccggtgccaattccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagctcctctgcagctggtatgtttatctcctagatccagagaatggagaagccaatcataaaccacacctgactgcaaattgcagcgttccttcagcccaggccagatcncagatgagttaaactctgctccaagacagggaaataaacatgtgcaccagcttgtcagtgaggtcatttcttcagccagcaaagtaacggatgccttgagaatgtaaaatggacatattgtggatgttacaaactttccttctcccttgcattgttttcttggccttcaaggtagctaaaatgctcataattttttatgtcattccctgtataaaggtggtggtggctccaaagacattgtccttagaaaaggacagaaaattgaaagtacagcagtgtttgtttgggcctatgttcagcatgttgtcaaaaaaaaatgcatgttttactctcttggagaatagcactgggcagaagtctgttgctgtaagatctaaggactgctctaggccagacccatgcgtctttcattccggtagttaatctctgacagtagctctagaggacctagagaggcacagttgtcttgctgaaactaagagggtaggttctcagcgtgcttcttatttttcttcatccaaaaatgaagcagatttttttctcccaaatatctatcttccttagtaacttagagatcattcatgaattgatctaaacctattcttgaaagctttaaccttggataccttttggagtaatatgtttcataactttattcttctctgctcctgatttctgttttcttattttaattttcagaatttaagttgtttgtgacttcatcatttatgatttagatcagagatcagcaaaccttttcttctaaagccagacagtaaatattttaggctccatgaagcagatggactctattgcagctactcaactctgctgttgtattgtgaaaacagccacagataatacataaacgaatgagcatggctgtgttccagtaaaacttcatttataaaagcaggcagccagctggatttggcccctgggccatcatttgccaagccctgattttgattttggcatcttgctcttcctaaaccccagccttgtcttctatattatttgagttgcttttcgaggtcttctactctgtgtctttctggggttccagtgtacacatgacaaactatactagacgatgtaccatcgtttaaacaagcgtagaacatatcttctgctagctttcctgtctgtatccaggatttgattgatttttacagtaatatagttgactgtttccaggaaatatattccagtagtcattaggtatctttgtatctatgttgtaatcgatagcgtggagcctgtcatctttaatatgttttatattattttcctttactatcatatgtctgcctttgttgaaactcagcttccaaccctcacttgctccagtcttttcaatttgtcactgtcagcaagcagagttgaatgcaaccagtgggtttggagatgttcccgagttccttcttgcaaatcatttgtaagaaggcctaacattatccctgtggtactctgcagtttgttctctttccagaactgtatccatttagtcatagcctttgttactgtctttctgagccacttctctgctgaaacaatctcccaaatccatagggatttggtcttttaaataacaaaaattttagtaaatgcttcaatcatctttttttccaatatattcaacagtgcactgggaataacatacaaactagttatatgtagaggctaccacaatcattttctttttttaaacacttgtaactggtatcttgttttgttgtgagctattaaaacacctgaacaagtcatttctccaattaaacattttatgtccatac

SEQ ID NO: 435389 - DNA, 2952 bp, Homo sapiens
  misc_feature (1156)..(1156): n is a, c, g, or t
agaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggtatctttgcctctagttttcagtttgtttggagaagctggctatctcagataaacaaatctggaacttggaagagatactgtgagatatgcagacttgggacgttggttttcataggctggtgaagacagaaccatttcccatttcagcaagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagctcctctgcagctggtatgtttatctcctagatccagagaatggagaagccaatcataaaccacacctgactgcaaattgcagcgttccttcagcccaggccagatcncagatgagttaaactctgctccaagacagggaaataaacatgtgcaccagcttgtcagtgaggtcatttcttcagccagcaaagtaacggatgccttgagaatgtaaaatggacatattgtggatgttacaaactttccttctcccttgcattgttttcttggccttcaaggtagctaaaatgctcataattttttatgtcattccctgtataaaggtggtggtggctccaaagacattgtccttagaaaaggacagaaaattgaaagtacagcagtgtttgtttgggcctatgttcagcatgttgtcaaaaaaaaatgcatgttttactctcttggagaatagcactgggcagaagtctgttgctgtaagatctaaggactgctctaggccagacccatgcgtctttcattccggtagttaatctctgacagtagctctagaggacctagagaggcacagttgtcttgctgaaactaagagggtaggttctcagcgtgcttcttatttttcttcatccaaaaatgaagcagatttttttctcccaaatatctatcttccttagtaacttagagatcattcatgaattgatctaaacctattcttgaaagctttaaccttggataccttttggagtaatatgtttcataactttattcttctctgctcctgatttctgttttcttattttaattttcagaatttaagttgtttgtgacttcatcatttatgatttagatcagagatcagcaaaccttttcttctaaagccagacagtaaatattttaggctccatgaagcagatggactctattgcagctactcaactctgctgttgtattgtgaaaacagccacagataatacataaacgaatgagcatggctgtgttccagtaaaacttcatttataaaagcaggcagccagctggatttggcccctgggccatcatttgccaagccctgattttgattttggcatcttgctcttcctaaaccccagccttgtcttctatattatttgagttgcttttcgaggtcttctactctgtgtctttctggggttccagtgtacacatgacaaactatactagacgatgtaccatcgtttaaacaagcgtagaacatatcttctgctagctttcctgtctgtatccaggatttgattgatttttacagtaatatagttgactgtttccaggaaatatattccagtagtcattaggtatctttgtatctatgttgtaatcgatagcgtggagcctgtcatctttaatatgttttatattattttcctttactatcatatgtctgcctttgttgaaactcagcttccaaccctcacttgctccagtcttttcaatttgtcactgtcagcaagcagagttgaatgcaaccagtgggtttggagatgttcccgagttccttcttgcaaatcatttgtaagaaggcctaacattatccctgtggtactctgcagtttgttctctttccagaactgtatccatttagtcatagcctttgttactgtctttctgagccacttctctgctgaaacaatctcccaaatccatagggatttggtcttttaaataacaaaaattttagtaaatgcttcaatcatctttttttccaatatattcaacagtgcactgggaataacatacaaactagttatatgtagaggctaccacaatcattttctttttttaaacacttgtaactggtatcttgttttgttgtgagctattaaaacacctgaacaagtcatttctccaattaaacattttatgtccatac

SEQ ID NO: 435390 - DNA, 753 bp, Homo sapiens
  misc_feature (31)..(31): n is a, c, g, or t
  misc_feature (725)..(725): n is a, c, g, or t
  misc_feature (737)..(737): n is a, c, g, or t
  misc_feature (749)..(749): n is a, c, g, or t
gggggccagtgggcccaggggcatgtcaggntcggctccaacgtgtcaatatgctgttgattcccagagatgttgcgggaagagggaaagtggggaagaaaggggtggtactgaaggggaactcggcctcctcctgaaggccttcctaaggctgacccctgggtcaaaccaaaatccccataatggcaaaagacaactcaagaagcaaaaagcagggtcaaggagctcttgaaaaattgcatagtaggagaggccccaccccaacaggaaggctgggctgcagaacacggtcccaagagctgcatccaagtatcatcccaaaggacagcgtggagtcggcccccttcctgccgccccggggttcgggaccctcggaagaccactcacgcgcccgcacgagaacacgtgaacacacacgcacgcacacatgcacgcgcgcacatgcactccctttctctcgcagcctcacacaactgggataggtcggtactccctgcaggctcgtgccgaattcggcacgaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaacacgtgccgaattcatgcagcccggaggatccncgagttatagancggaagccaccnggtg

SEQ ID NO: 435391 - DNA, 503 bp, Homo sapiens
aaaaacatcctctgaagcctctctaacccagggatcctcctcactcttcccctacccattccccccaccctccgttatactggggccagttatctagtagatactgccaattacccttggcagaggtgccctgctcactaatttcatttgaaggagagccctggaacctggttttaatgtctggcacacgccactccaggatctcccagtttgtgtttctacatctgcaggctgatgctgatttctaaccaccccatgtcaatcattttagtttgtgggcatcacctatgccctgaccgttgtgtggctcctggtgtttgcctgctctgctgtgcctgtgtacatttacttcaacacctggaccacctgcccgcgcaaggtgttttccaagccagagagttgtgcccggatagccagtgtcatgggctgaaggcagaatgtatgattttatacgatcgaactgagattgcttagatggattatggtcgtctaacatatggaca

SEQ ID NO: 435392 - DNA, 3033 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435393 - DNA, 3021 bp, Homo sapiens
  misc_feature (2978)..(2978): n is a, c, g, or t
  misc_feature (2993)..(2993): n is a, c, g, or t
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaggtaattatcagcagttttcaaacaaggtgtaattnttaacggcgccgggnaaaataaatacatcttttccccctcatc

SEQ ID NO: 435394 - DNA, 2974 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435395 - DNA, 2928 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacgtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435396 - DNA, 2974 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaagtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435397 - DNA, 2978 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435398 - DNA, 2693 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaccgaattcggcacgagtctcaacacagataccaccactttctttttcccattatagacatggtgaatccacacagcatacttcatctctgagctatgatgtgattcctcaacacattaccctaaccagccagcagttacagatttcagagtgatgcagttctgtt

SEQ ID NO: 435399 - DNA, 2886 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacgtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgaggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435400 - DNA, 3253 bp, Homo sapiens
agcggagtcttctatgccaggctaggaaagctgccttccaaaatttggtctgggaagacattatcctgggaatgagaagcaaagcctcagctctagaagcccaaataatagcagatgaccccaggctttcactggcacccagtacaggcagcaggctgccaccaagaaggctggcagtgccctcttgaggaatcccttggcagtgccaggagcctagctggactcaagaatattttgccaagggcacccagcagaaccaatggaagcagaatcacagaaataggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435401 - DNA, 2979 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccatcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435402 - DNA, 3107 bp, Homo sapiens
agcggagtcttctatgccaggctaggaaagctgccttccaaaatttggtctgggaagacattatcctgggaatgagaagcaaagcctcagctctagaagcccaaataatagcagatgaccccaggctttcactggcacccagtacaggcagcaggctgccaccaagaaggctggcagtgccctcttgaggaatcccttggcagtgccaggagcctagctggactcaagaatattttgccaagggcacccagcagaaccaatggaagcagaatcacagaaataggagaagaggacaaagatactcagagagaaaaagtaaaagaccgaagaaggaggctggagagctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435403 - DNA, 2874 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccatcatctatggaactgcctctttcttcttcctttatggggccctcctgctggctgagggcttctacaccaccggcgcagtcaggcagatctttggcgactacaagaccaccatctgcggcaagggcctgagcgcaacgtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435404 - DNA, 2583 bp, Homo sapiens
actggtgatgctagaggtgatgtttttggtaaacaggcggggtaagatttgccgagttccttttactttttctcgtgccgaattcggcacgaggtttaacagccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435405 - DNA, 2682 bp, Homo sapiens
aaaaacatcctctgaagcctctctaacccagggatcctcctcactcttcccctacccattccccccaccctccgttatactggggccagttatctagtagatactgccaattacccttggcagaggtgccctgctcactaatttcatttgaaggagagccctggaacctggttttaatgtctggcacacgccactccaggatctcccagtttgtgtttctacatctgcaggctgatgctgatttctaaccaccccatgtcaatcattttagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435406 - DNA, 2095 bp, Homo sapiens
tcccccggctgaggaattcggcacgagtaatgagacctatttctccaaaaactaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435407 - DNA, 1906 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgaggctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435408 - DNA, 1763 bp, Homo sapiens
  misc_feature (1750)..(1750): n is a, c, g, or t
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccctcgtaggaagagacacccttgggtttcaaaggactgagaatganggaacttactaca

SEQ ID NO: 435409 - DNA, 1387 bp, Homo sapiens
  misc_feature (15)..(15): n is a, c, g, or t
gtgaacctgctaatnacagaaacttaatgtagacctgttctggggtctactattgttttagaatgaaggaattgtattatgtgtgtgtatatataatttgtaaataaaaagtatggtagaagtcggttctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435410 - DNA, 1187 bp, Homo sapiens
  misc_feature (22)..(22): n is a, c, g, or t
  misc_feature (30)..(30): n is a, c, g, or t
agtaccctcgcgaacgtgttanccaaagantatctaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435411 - DNA, 1225 bp, Homo sapiens
taacagagaaggagctattatatgaaaaaaaagatatattttaagggtctctctctatagaaaagaggtgaaattctccctttattaacgaacagaacttgtttaaattaataaagattctattaaaggtgttaaaacagtttgggcaagggactagagccttgatacaagaaaactttggaaactgtttttggtaatatggacttgctggaatattcaagggccattatggattacatcagcacgagtaatgagtctattgttaaataagcattcatgattcagttgttatcctattgaggtgcacaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435412 - DNA, 823 bp, Homo sapiens
  misc_feature (17)..(18): n is a, c, g, or t
tagaggatcccccgacnncccatctgccaaccagttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435413 - DNA, 1197 bp, Homo sapiens
  misc_feature (31)..(31): n is a, c, g, or t
gggggccagtgggcccaggggcatgtcaggntcggctccaacgtgtcaatatgctgttgattcccagagatgttgcgggaagagggaaagtggggaagaaaggggtggtactgaaggggaactcggcctcctcctgaaggccttcctaaggctgacccctgggtcaaaccaaaatccccataatggcaaaagacaactcaagaagcaaaaagcagggtcaaggagctcttgaaaaattgcatagtaggagaggccccaccccaacaggaaggctgggctgcagaacacggtcccaagagctgcatccaagtatcatcccaaaggacagcgtggagtcggcccccttcctgccgccccggggttcgggaccctcggaagaccactcacgcgcccgcacgagaacacgtgaacacacacgcacgcacacatgcacgcgcgcacatgcactccctttctctcgcagcctcacacaactgggataggtcggtactccctgcaggctcgtgccgaattcggcacgaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435414 - DNA, 853 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaaggtgatcatcctcaggattttgtggcaataacaaggggtgggggaaaattgggcgcgagtctgtggcctcgtccccacccaaggctgggtcctctctaggggcctggcatttgagtgaggaagcgatggctgcagccgaacgagaaggtcaggaagaacgtggtgcccagctggcttagcctcacctttcaaaggttccctaagcaaatttcttctcaaaacagaaagcatg

SEQ ID NO: 435415 - DNA, 3290 bp, Homo sapiens
agcggagtcttctatgccaggctaggaaagctgccttccaaaatttggtctgggaagacattatcctgggaatgagaagcaaagcctcagctctagaagcccaaataatagcagatgaccccaggctttcactggcacccagtacaggcagcaggctgccaccaagaaggctggcagtgccctcttgaggaatcccttggcagtgccaggagcctagctggactcaagaatattttgccaagggcacccagcagaaccaatggaagcagaatcacagaaataggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435416 - DNA, 2976 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtactcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggaaaatgattttacttagcaatgttatcttggtgtgttaagagttaggtttaacataaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435417 - DNA, 2979 bp, Homo sapiens
agcggagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaaggtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctcttgccatctataggggccaaatatattctctttggtgtacaaaatggaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatggccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattccagtttgtttattacttatttggggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctttctagctaatggtaaaggttattttctcctgatatagatcacataacagaatgcaccagtcatcagctattcagttggtaagcttccaggaaaaaggacaggcagaaagagtttgagacctgaatagctcccagatttcagtcttttcctgtttttgttaactttgggttaaaaaaaaaaaaagtctgattggttttaattgaaggaaagatttgtactacagttcttttgttgtaaagagttgtgttgttcttttcccccaaagtggtttcagcaatatttaaggagatgtaagagctttacaaaaagacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttataaaattaaagaaaataaaattaagaatgttctcaatcaaaaaaaaaaaa

SEQ ID NO: 435418 - DNA, 1845 bp, Homo sapiens
gaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaag

SEQ ID NO: 435419 - DNA, 2553 bp, Homo sapiens
gaaactcaaccgaaagcctgcagagagcagaacatggaaggagacttctcggtgtgcaggaactggtaagaaagtgctttctccagcggcagacccgggctggcgagggagagacgtagacgacatagggctgtttctgaagggagcagaaagtggttcctgcataagaacacttaggaggacaagcagctggagaccgtgggccccaaggtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggcttatggatctggcataggcaagaggttctggtttcaggaaagactggctgttctcttgagatctgtaaagagaggatgtgaaaaaggaaggtcctggaaggcagtcagatggagccctgtttcccgcctttccatgtccattcctcctggggcccctgatctgtctctctggagatactcaagctcaggcagccgttgccaactcagactggtctgacaaacacttcttgaacactgggcggggtgctagagagacactgaggtagccacatcggatccctgccctctgggagttcacagacccaaacccggaacactgtgagccaaagtggatgtggggcaggccctgggtgctgggtggacccacatctggtgtgtgtgtgtgtgtgtgtgtgtgtgtttaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaagaaaccagtcctgatccaggaaaatgtctctccattacggttgctgctgccctgagtgcacatctgtggccataaaggaaatgatgtgggtgattcggccaagagttgcctgtgtggtcaaggatgccggcagcgcaggaaagtcaagaccaggcaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaag

SEQ ID NO: 435420 - DNA, 2353 bp, Homo sapiens
gaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggcttatggatctggcataggcaagaggttctggtttcaggaaagactggctgttctcttgagatctgtaaagagaggatgtgagtccattcctcctggggcccctgatctgtctctctggagatactcaagctcaggcagccgttgccaactcagactggtctgacaaacacttcttgaacactgggcggggtgctagagagacactgaggtagccacatcggatccctgccctctgggagttcacagacccaaacccggaacactgtgagccaaagtggatgtggggcaggccctgggtgctgggtggacccacatctggtgtgtgtgtgtgtgtgtgtgtgtgtgtttaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaagaaaccagtcctgatccaggaaaatgtctctccattacggttgctgctgccctgagtgcacatctgtggccataaaggaaatgatgtgggtgattcggccaagagttgcctgtgtggtcaaggatgccggcagcgcaggaaagtcaagaccaggcaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaag

SEQ ID NO: 435421 - DNA, 2499 bp, Homo sapiens
gaaactcaaccgaaagcctgcagagagcagaacatggaaggagacttctcggtgtgcaggaactggtaagaaagtgctttctccagcggcagacccgggctggcgagggagagacgtagacgacatagggctgtttctgaagggagcagaaagtggttcctgcataagaacacttaggaggacaagcagctggagaccgtgggccccaaggtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggcttatggatctggcataggcaagaggttctggtttcaggaaagactggctgttctcttgagatctgtaaagagaggatgtgaaaaaggaaggtcctggaaggcagtcagatggagccctgtttcccgcctttccatgtccattcctcctggggcccctgatctgtctctctggagatactcaagctcaggcagccgttgccaactcagactggtctgacaaacacttcttgaacactgggcggggtgctagagagacactgaggtagccacatcggatccctgccctctgggagttcacagacccaaacccggaacactgtgagccaaagtggatgtggggcaggccctgggtgctgggtggacccacatctggtgtgtgtgtgtgtgtgtgtgtgtgtgtttaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaagaaaccagtcctgatccaggaaaatgtctctccattacggttgctgctgccctgagtgcacatctgtggccataaaggaaatgatgtgggtgattcggccaagagttgcctgtgtggtcaaggatgccggcagcgcaggaaagtcaagaccaggcaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctccaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaag

SEQ ID NO: 435422 - DNA, 2197 bp, Homo sapiens
ggctttttccattatcaacaatggccagaagggagttagcaatggctcctggcctgggggcctatgtattggctccctggtaccattttatgttcacttgaatcactcacctctttatgagggtgtatttactgtcacacaaccatcagtgtgacagatcctttggtgtctttgctagttgttttggtaacatggtaacatgggagagagcctaaaactccccagacagtaaccttctcctgataaacaatccacccaagggcaaaactggccaatggaaacctggaaattgtgagagtcatgtatatttccttcatcccagcatggctggacgtcaacagaatcaaacacagtcttcaacacaacttcagtgcaacacaacacaacacaacacaacacagcttcaacactgtcaacaaaaatgtgttcaaccaacacctggtctgatcacagagtctgaaaactggtgcaatgaaagagcacagtcagaatggagggggttggcatccgtggctacagctccattcatctccttagaaaccagtcctgatccaggaaaatgtctctccattacggttgctgctgccctgagtgcacatctgtggccataaaggaaatgatgtgggtgattcggccaagagttgcctgtgtggtcaaggatgccggcagcgcaggaaagtcaagaccaggcaggtccggggggcagttcgtgctcatgagcacaggccatgtatgcagttgtgggagagctgggctagccgttgacaaggacaatcatttgtggtgttgtttctctgcttattcaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaag

SEQ ID NO: 435423 - DNA, 1788 bp, Homo sapiens
gaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaag

SEQ ID NO: 435424 - DNA, 1592 bp, Homo sapiens
gaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaag

SEQ ID NO: 435425 - DNA, 1925 bp, Homo sapiens
gatgggactttcctgtcatccaagcccctagttacaaagttgaccctacatctcccataagcagtgtcaactcctgtgcttaaccagtccatttgtgctgctataacaggatgccacagacagagtaataataaagaacacaaatttatttcgaacagttctgaagactgggaagttcaagatcaaggcaccaccatttggtgtctggtgagggccttcttgctgcctcctagcatggtagaaagcaaaagagtagaaggctgtagccaaatacttcatgaatcctcttttataaggaccctaatctcattaaaaagggaggacctttcatgatctaatcacccccgaaggccccacctcttaataccatcacattggcagcacctgaattttggaggagacacattcaaaccatagcaaccagtcagaccttcattcctggaatgcaaaattttctttctttcctgcaaagccagctattaaattgaatgtctgtcacattttatacaccatataaaagtgtttacagtgggaatttcttgtgttatctagtctactgtattttctgaccattaaagctgaagtcattttaaaatttgatatattattcacaattgcagggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaag

SEQ ID NO: 435426 - DNA, 1247 bp, Homo sapiens
gaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggcttatggatctggcataggcaagaggttctggtttcaggaaagactggctgttctcttgagatctgtaaagagaggatgtgagtccattcctcctggggcccctgatctgtctctctggagatactcaagctcaggcagccgttgccaactcagactggtctgacaaacacttcttgaacactgggcggggtgctagagagacactgaggtagccacatcggatccctgccctctgggagttcacagacccaaacccggaacactgtgagccaaagtggatgtggggcaggccctgggtgctgggtggacccacatctggtgtgtgtgtgtgtgtgtgtgtgtgtgtttaggttgggtgtacgatgtgtcagcagagcatgcagaagtcctcgctggagtttcataaggtaagagccccatgtgatttctcctttacagccaaatagaccaacctgagaaaaggagaggaaggggaaacgggaggccagtaatagagatttccacctgaccactcttttcaccccattaggcttggagagcagtggagaactagcccaccgcataacacaggttctcctgtcccccagatactgatcagaagggttttccatggtccatgagtccatcagagctcagatcccccgaaggcagtcccgcactctggcccttctcatctgctttctcgtattggccctaattccctagggagatgggcacaagtccttgatctgcctacagtcaaagaggccagtgatcggccaggcgcagtggcacacgcctgtaatcccagcactttgggaggccaaggcgggtggatcacgaggtcaggagttcgagaccagcctgaccaacatggtgaaaccccgtctctactaaaagtacaaaaattagctgggcgtggtggcacacgcctgtggtcccagccacttgggaggctgaggcaggagaattgcttgaacccgggaggcggaggttgcagtgagccaagatcaagccactgcactccagcctgggcaacacaatgagactctgtctcaaaaaaaa

SEQ ID NO: 435427 - DNA, 580 bp, Homo sapiens
ccatatcaaactttttttatatccatttcttaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatc

SEQ ID NO: 435428 - DNA, 304 bp, Homo sapiens
cccatggaaaggaaatgttaatcctgcctttttcatgctaatctgagtctacctccagttttcctatttccaatcctttccctacaggcttatggatctggcataggcaagaggttctggtttcaggaaagactggctgttctcttgagatctgtaaagagaggatgtgaaaaaggaaggtcctggaaggcagtcagatggagccctgtttcccgcctttccatgtccattcctcctggggcccctgatctgtctctctggagatactcaagctcaggcagccgttgccaactcagactggtct

SEQ ID NO: 435429 - DNA, 5864 bp, Homo sapiens
  misc_feature (2)..(3): n is a, c, g, or t
  misc_feature (5246)..(5246): n is a, c, g, or t
cnncggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgatggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtanccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttgg

SEQ ID NO: 435430 - DNA, 5909 bp, Homo sapiens
  misc_feature (2)..(3): n is a, c, g, or t
  misc_feature (5291)..(5291): n is a, c, g, or t
cnncggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgatggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaagaatccatctagaggacacactgtgttaaaaattaaacataaaagaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtanccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttgg

SEQ ID NO: 435431 - DNA, 3330 bp, Homo sapiens
  misc_feature (2)..(3): n is a, c, g, or t
cnncggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgatggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaa

SEQ ID NO: 435432 - DNA, 888 bp, Homo sapiens
aaactataatgcaattcattttttaaaaaattttactgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaaaaaaaaaaaaaaatgggctctttgggctcaaggggggaactctggggccgttccctttaggagggtatattgacctcg

SEQ ID NO: 435433 - DNA, 1305 bp, Homo sapiens
  misc_feature (31)..(31): n is a, c, g, or t
  misc_feature (45)..(46): n is a, c, g, or t
catcaaccctaaatgtattatgtgaattttntacaatacaaaccnnaaatacagaaatgccatatatgaatactgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgtagttggatatactaccgaacaatatctcatctctttttagggaaataaagtttgtgcatatatataatcccgaaacatg

SEQ ID NO: 435434 - DNA, 6921 bp, Homo sapiens
  misc_feature (2)..(3): n is a, c, g, or t
  misc_feature (5246)..(5246): n is a, c, g, or t
cnncggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgatggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtanccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgtagttggatatactaccgaacaatatctcatctctttttagggaaataaagtttgtgcatatatataatcccgaaacatg

SEQ ID NO: 435435 - DNA, 4459 bp, Homo sapiens
  misc_feature (2784)..(2784): n is a, c, g, or t
gtaaaataataacgcacatacatcattatattattctattcaacagtagctaggaatccatctagaggacacactgtgttaaaaattaaacataaaagaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtanccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgtagttggatatactaccgaacaatatctcatctctttttagggaaataaagtttgtgcatatatataatcccgaaacatg

SEQ ID NO: 435436 - DNA, 4444 bp, Homo sapiens
  misc_feature (2769)..(2769): n is a, c, g, or t
gtgatatagaccaatcatttgcattttctgtgtgcttggaatccatctagaggacacactgtgttaaaaattaaacataaaagaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtanccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgtagttggatatactaccgaacaatatctcatctctttttagggaaataaagtttgtgcatatatataatcccgaaacatg

SEQ ID NO: 435437 - DNA, 4976 bp, Homo sapiens
  misc_feature (3301)..(3301): n is a, c, g, or t
gcaacacaagcgactggactatgaacagtgcaaagtctggcgtcgcgatccggataatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtanccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgtagttggatatactaccgaacaatatctcatctctttttagggaaataaagtttgtgcatatatataatcccgaaacatg

SEQ ID NO: 435438 - DNA, 868 bp, Homo sapiens
gtaaaataataacgcacatacatcattatattattctattcaacagtagctaggaatccatctagaggacacactgtgttaaaaattaaacataaaagaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaa

SEQ ID NO: 435439 - DNA, 4457 bp, Homo sapiens
  misc_feature (2782)..(2782): n is a, c, g, or t
cagacgccccccgtcctcgcgccctcccgccccccgcaccaccccccaattagggataaactaccggcaacacttggttaaaaattaccacataaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtanccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgtagttggatatactaccgaacaatatctcatctctttttagggaaataaagtttgtgcatatatataatcccgaaacatg

SEQ ID NO: 435440 - DNA, 4437 bp, Homo sapiens
  misc_feature (2762)..(2762): n is a, c, g, or t
aaagtagaaggcgaccaagagcaaaggggccctcgctccgcgtcgcgagctcagatatgacgtgggatgtatgagcaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtanccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgtagttggatatactaccgaacaatatctcatctctttttagggaaataaagtttgtgcatatatataatcccgaaacatg

SEQ ID NO: 435441 - DNA, 4430 bp, Homo sapiens
  misc_feature (47)..(47): n is a, c, g, or t
  misc_feature (57)..(57): n is a, c, g, or t
  misc_feature (2755)..(2755): n is a, c, g, or t
attattcttcctcttatttggagcgtaaacaaaaagagcacgcctgntaggtgaacncggatgtatcataaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtanccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgtagttggatatactaccgaacaatatctcatctctttttagggaaataaagtttgtgcatatatataatcccgaaacatg

SEQ ID NO: 435442 - DNA, 4401 bp, Homo sapiens
  misc_feature (2726)..(2726): n is a, c, g, or t
aaactataatgcaattcattttttaaaaaattttactgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtanccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgtagttggatatactaccgaacaatatctcatctctttttagggaaataaagtttgtgcatatatataatcccgaaacatg

SEQ ID NO: 435443 - DNA, 2649 bp, Homo sapiens
  misc_feature (6)..(6): n is a, c, g, or t
  misc_feature (12)..(12): n is a, c, g, or t
  misc_feature (42)..(42): n is a, c, g, or t
  misc_feature (47)..(47): n is a, c, g, or t
  misc_feature (49)..(49): n is a, c, g, or t
  misc_feature (974)..(974): n is a, c, g, or t
acgcantatggngagactgatgaaccccggtgcggtgtttanaaaanangcagtgtacggccgattccggatgaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtanccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgtagttggatatactaccgaacaatatctcatctctttttagggaaataaagtttgtgcatatatataatcccgaaacatg

SEQ ID NO: 435444 - DNA, 1463 bp, Homo sapiens
  misc_feature (1398)..(1398): n is a, c, g, or t
  misc_feature (1400)..(1400): n is a, c, g, or t
  misc_feature (1402)..(1402): n is a, c, g, or t
  misc_feature (1404)..(1404): n is a, c, g, or t
  misc_feature (1420)..(1420): n is a, c, g, or t
  misc_feature (1426)..(1426): n is a, c, g, or t
gcaacacaagcgactggactatgaacagtgcaaagtctggcgtcgcgatccggataatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaaaaaaaaaaaaggncntntnggctaagggggacttncggccnttcctgtgggggggaatctaagcctggtaaggagtgt

SEQ ID NO: 435445 - DNA, 1476 bp, Homo sapiens
  misc_feature (1451)..(1451): n is a, c, g, or t
  misc_feature (1456)..(1456): n is a, c, g, or t
  misc_feature (1459)..(1460): n is a, c, g, or t
gcaacacaagcgactggactatgaacagtgcaaagtctggcgtcgcgatccggataatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaaaagaaaaaattggcctcttggcctcagcggtggagctttgcggccgttcctttatggaggttattnatganccnnctacttacccttgtct

SEQ ID NO: 435446 - DNA, 1450 bp, Homo sapiens
gcaacacaagcgactggactatgaacagtgcaaagtctggcgtcgcgatccggataatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttttgtgagtttcgggggaataaaaaaaagataattgaccctcggcccgataagtgacctcttaggcctttccttaactaggtaaatataat

SEQ ID NO: 435447 - DNA, 1274 bp, Homo sapiens
gcaacacaagcgactggactatgaacagtgcaaagtctggcgtcgcgatccggataatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaag

SEQ ID NO: 435448 - DNA, 682 bp, Homo sapiens
gtaaaataataacgcacatacatcattatattattctattcaacagtagctaggaatccatctagaggacacactgtgttaaaaattaaacataaaagaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagt

SEQ ID NO: 435449 - DNA, 1025 bp, Homo sapiens
cgcggctgagggatccctgggagccgcggtgcattgtgggagaacgaaagatggcggcgcccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattactg

SEQ ID NO: 435450 - DNA, 790 bp, Homo sapiens
gtgctctcgaggatctcggtgttcctttgtctctactgcagcgattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattactg

SEQ ID NO: 435451 - DNA, 463 bp, Homo sapiens
ataattttgggagccagagtaaacagatggctgtatccttaccttccaattgtgatttttctttcctccctcttcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattactg

SEQ ID NO: 435452 - DNA, 667 bp, Homo sapiens
gtgctctcgaggatctcggtgttcctttgtctctactgcagcgattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggacaaagggaaacaccggtgtctccctttgtctcctccccttcaccaaatctgtggctttacctccaaaatttctgtctccattgccacttctccgtcggctacccctgtca

SEQ ID NO: 435453 - DNA, 1027 bp, Homo sapiens
cgcggctgagggatccctgggagccgcggtgcattgtgggagaacgaaagatggcggcgcccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgccgtcgattcgagggatcctctaga

SEQ ID NO: 435454 - DNA, 1030 bp, Homo sapiens
cgcggctgagggatccctgggagccgcggtgcattgtgggagaacgaaagatggcggcgcccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgctcgtgccgaatcctgcagcccggggga

SEQ ID NO: 435455 - DNA, 1735 bp, Homo sapiens
cgcggctgagggatccctgggagccgcggtgcattgtgggagaacgaaagatggcggcgcccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacaggttgtgatccttttaggccagccagaaggaagggaaaaggggtatttggattcccaaataaaagacagttgcttggcccctgctttgtgttttaagtaacaaataatttcatattcttttctttgttgctcacatctaccataatacgacttaaaaagtctgtcttattttcgggtgagaggtaagggtattggaatagccttttctctcagttaaactttgtgaatgttatctgtgtttaactccaagtttgagactgagagtggggcaaatgaagcctttttccactaattcctgtgttttatgtgaaatccctcttaaagcgggagattgagttctgttttccttgtttcacagatgaagactgaagaacagagaaagtaggggctagttaagtcagtaatagtatcaaaaccaatgaagtagttgtgtttgaattagtatgatcattgtttcttttttgaagactcaaaatatggtttgctgttcaaagaagcttacctcttgatttcttaccttttagtttcctcaagattgtgagactcttccctggaagaggtcagagttagagagatgggtcgaggtgtaatttggttctaagctctttgagggcaaggattgtggatcttaaaggaagattgtaaaactccaggtttcttggttctggcagatcacagtcttcttacctcctctgaccccctttgctgtagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattactg

SEQ ID NO: 435456 - DNA, 1681 bp, Homo sapiens
cgcggctgagggatccctgggagccgcggtgcattgtgggagaacgaaagatggcggcgcccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagattgagatagagagaagcctgtattcagaccacgagcttcgtgctctggatgaggatatattgctggcgcaagatttggaagatatgtgggagcagaaatttctacagttcaaacttggagctcgcataacaggttgtgatccttttaggccagccagaaggaagggaaaaggggtatttggattcccaaataaaagacagttgcttggcccctgctttgtgttttaagtaacaaataatttcatattcttttctttgttgctcacatctaccataatacgacttaaaaagtctgtcttattttcgggtgagaggtaagggtattggaatagccttttctctcagttaaactttgtgaatgttatctgtgtttaactccaagtttgagactgagagtggggcaaatgaagcctttttccactaattcctgtgttttatgtgaaatccctcttaaagcgggagattgagttctgttttccttgtttcacagatgaagactgaagaacagagaaagtaggggctagttaagtcagtaatagtatcaaaaccaatgaagtagttgtgtttgaattagtatgatcattgtttcttttttgaagactcaaaatatggtttgctgttcaaagaagcttacctcttgatttcttaccttttagtttcctcaagattgtgagactcttccctggaagaggtcagagttagagagatgggtcgaggtgtaatttggttctaagctctttgagggcaaggattgtggatcttaaaggaagattgtaaaactccaggtttcttggttctggcagatcacagtcttcttacctcctctgaccccctttgctgtagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattactg

SEQ ID NO: 435457 - DNA, 838 bp, Homo sapiens
cgcggctgagggatccctgggagccgcggtgcattgtgggagaacgaaagatggcggcgcccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattactg

SEQ ID NO: 435458 - DNA, 981 bp, Homo sapiens
cgcggctgagggatccctgggagccgcggtgcattgtgggagaacgaaagatggcggcgcccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaaagggaaacaccgtgctccgaggtactctctgtccgcattgcctagggatcctctaag

SEQ ID NO: 435459 - DNA, 5650 bp, Homo sapiens
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctatcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaatcttgaaaaatagtg

SEQ ID NO: 435460 - DNA, 273 bp, Homo sapiens
acttttacatagtttggttcatgatgcatatacgtttcaagtattttgtgatgtcatttttttccggctttttaattctttctagtgacagcccagacaattttaatgttagtgacatcaacccaattctgtgctaacaagtgtcataaaaacaattcagctgtaactgaaaacacttggcatgcgactgtgtgacttaggcgttgattacattatcagtgtcagaaattttgaaaattgacttctaaaaacctatacacatcttacctaatt

SEQ ID NO: 435461 - DNA, 5517 bp, Homo sapiens
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctatcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaatcttgaaaaatagtg

SEQ ID NO: 435462 - DNA, 2550 bp, Homo sapiens
gctgatccgcttagcataagggatatgcgtctgctgggtatttggttccaacacattagtttaagctaacaggggcacgttgtggtaatactcatgggtagcaaatttcggcttcacaagaaaataaaacctgcaacaaaaaagtagaaaggaaggccctcaaatgatttctctccctttctctgggtctctcggctttgcctctctctctgtgtatatggcattctgtcctccctcagaacccctactttctctgtgtcagcacgcacaagccaagatagatgtcataaagttaatgaaacttaagcggatcaggctgatccgcttaagggggaaaaaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctatcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaatcttgaaaaatagtg

SEQ ID NO: 435463 - DNA, 5620 bp, Homo sapiens
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctatcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagaccttaaagttatgttattatatgtggaagtgtaaatatagatttggtgttttgcaatcttgaaaaatagtg

SEQ ID NO: 435464 - DNA, 714 bp, Homo sapiens
aagttgggattacaggcgtcagccactgtgcctggccgtagtcttatattattttatatcgtcttagagatttttattggtatttaatacagattgtaagttgtcttctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaatcttgaaaaatagtg

SEQ ID NO: 435465 - DNA, 3486 bp, Homo sapiens
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggtattgcatgaggggcgtcgtgtttaaatggctgcctacagtgattaatagctaatccaggcattctcagtggagatggtaccactcccaagggtggggggtaggcagccagaagttcttgggggtcacagagagaagcattcttagatacggcagtggtttgtggtcctccaaggct

SEQ ID NO: 435466 - DNA, 511 bp, Homo sapiens
ggactcaagcaatccttccatccttccgtctcagcctcccgagtagctgggactaaaggtgcatgtcaccatacccagctaattttttatttttagtagagaagaggtctcaccatgttgcctatgctggcaaatccccttttaaatgattttaaaaaaagcaaaaaacaacacttttacatagtttggttcatgatgcatatacgtttcaagtattttgtgatgtcatttttttccggctttttaattctttctagtgacagcccagacaattttaatgttagtgacatcaacccaattctgtgctaacaagtgtcataaaaacaattcagctgtaactgaaaacacttggcatgcgactgtgtgacttaggcgttgattacattatcagtgtcagaaattttgaaaattgacttctaaaaacctatacacatcttacctaattgtttgaccttaactctaaatatgttttttttttcaatcaggaaaaaggcctgtgtcatatcaacac

SEQ ID NO: 435467 - DNA, 2852 bp, Homo sapiens
  misc_feature (156)..(156): n is a, c, g, or t
  misc_feature (162)..(162): n is a, c, g, or t
ggcggcggcggcggcggcgaagaactgttccttccacctcttcagccccggcaggacgggggcggccgccgcgaacccggggcggggacagcacgcagcctcgaggcgcgcacccccgcccggcagcggccccgacacccggggcgagcgggaaancggcancggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagcacagagtaccaagacattgagactgagaaaacctgccccgaatcacattcaccttcagaagactcctttgtgagaagctgagggcctggccctcttcctcttcctggagagaacagccctccaccacccacagacctcgcgggcctcacttagcgtgctcctccctgtccgagaacccgagggtccccatgtggattatccagccagtgtgtggtcctttgaggccccaagcgcaggcctgtgatgaggaccaaagaggtgacttatggtcaggagtactccaaacagctctcagagtaggcatctttcctgggtctctaaagagtcatgctgacctggtgtgcaaattcccttccacccatccctctacctcctctggggatggcttgccgacatgctttagaaactcccctcttgggaatgctcctctgactgagggctccaacagctttaatgaaatcagccgagagggtaaaaaccaacctgttgcatagaatggaggggggaaaaagcacatactcaatagatttttgagtgtggtactctgtatttttgcagcatttattttccaaatgagcagtttagaaatatgtgatgtaaagtacatactgtacgtttgctgaaaattatattaaaagcactattttaattcttaaaatgt

SEQ ID NO: 435468 - DNA, 1571 bp, Homo sapiens
  misc_feature (778)..(778): n is a, c, g, or t
tgaaccccagctctctcacttcggtcccacccttcccaactccccacgcccaagtctttcagtggaacccaagactgtaagaacgtaggccttgtgagagtgaaggaaggatgctcgaacttgcccaggactcaggcttcagcttcacaatcccgaggaaaggaatgacatttccaaactgtcacctttgtagcgctgggtcaaagtctaaagaggacaaataaatagagacttctgtggcctcgttgtgcctattgaacaggagagctgcatgtcacaatcaatgagacctgcacagcttgtgaatcatcactgagactagttgtgtttttaatacctttaaaatgaagccacagcatctattctggaaatgtggcgtaggcttaaaaaccttgctccaaagaggatatcgtttcagccagcatgcagtgaatatctgtggctacacaaaaaaacaaactgtcccgaatgctggaggaggaaatatgacattgtgatgccaggcagttttctgtgacactcaggaatctcttcaatagagatgtacagtgacacttagagccccagaacacaaggtctgtcactagtaatttacataagataaggataaattattgactgggatacatcttactcatccccgacatctgcttggctgtggggttggtcatgtagataaatatccttcccagaaaggatatttggccttcaaaaaagtctctgggctcagagtctggtcccttggggttacatggaatgaaacccagcactttattgntttgactgcctactcttgtcccttcactgcaaagccatcatgctattaaataagcctaacaaacagtaggtgaagcagaaaagaccgatctctttttcctcttggctcttcttccctcctccccctttaggcacagagtaccaagacattgagactgagaaaacctgccccgaatcacattcaccttcagaagactcctttgtgagaagctgagggcctggccctcttcctcttcctggagagaacagccctccaccacccacagacctcgcgggcctcacttagcgtgctcctccctgtccgagaacccgagggtccccatgtggattatccagccagtgtgtggtcctttgaggccccaagcgcaggcctgtgatgaggaccaaagaggtgacttatggtcaggagtactccaaacagctctcagagtaggcatctttcctgggtctctaaagagtcatgctgacctggtgtgcaaattcccttccacccatccctctacctcctctggggatggcttgccgacatgctttagaaactcccctcttgggaatgctcctctgactgagggctccaacagctttaatgaaatcagccgagagggtaaaaaccaacctgttgcatagaatggaggggggaaaaagcacatactcaatagatttttgagtgtggtactctgtatttttgcagcatttattttccaaatgagcagtttagaaatatgtgatgtaaagtacatactgtacgtttgctgaaaattatattaaaagcactattttaattcttaaaatgt

SEQ ID NO: 435469 - DNA, 5099 bp, Homo sapiens
  misc_feature (156)..(156): n is a, c, g, or t
  misc_feature (162)..(162): n is a, c, g, or t
ggcggcggcggcggcggcgaagaactgttccttccacctcttcagccccggcaggacgggggcggccgccgcgaacccggggcggggacagcacgcagcctcgaggcgcgcacccccgcccggcagcggccccgacacccggggcgagcgggaaancggcancggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagtgagttctttgcctctactctgaccctagacaacctggggagggaccctgtgcccgcaaaccagacacataggacaaagtttatctataacctggaagaccatgagtggtgtgaaaacatggagtccgttttatagtgactaaaggagggctgaactctgtattagtaatccaagggtcatttttttcttaaaaaaagaaaaaaaggttccaaaaaaaaccaaaactcagtacacacacacaggcacagatgcacacacacgcagacagacacaccgactttgtcctttttctcagcatcagagccagacaggattcagaataaggagagaatgacatcgtgcggcagggtcctggaggccactcgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaaaaaaataaaaaaaaaaaacccacaagttgaaaacattgccagattaagcactagtgacacaccccgtgccaccctcttcctccaggtgggggtgggggcgggcgcacaagtcggaggggtggaagcaccactcctctctctgactttcgcaatatgggtcactgtgtagacgactcacccagtctgcatgtggttcaaggccccagagttctctcagtgatgctaatgggtgatccgtgctggagtttgtaattggcacctctcaccagctccatttccatgttcaagactgagggcctgagggggagccaggtggggggccagcacctcccagtggcgggcatccaccttcccccagccccacagagtgacctcaggaagcagtaggcctcgcctggctatgactgacccggctcagagctggtgagacccaacgcagtccaagtcatttgcttacatttgccaaaaacattttgccatttttaaaagaaaaaaatacaatccatatgaattttaaactgttgtatgtataatcctctaatactatttttaactacttctaaaatctgtgttaacccttcaagtcactaacacagttctctaggccggatttattatgctggttgcttttactttttttctccttttttaatgcaccaaaaatatgtgatacaagggatgcaattaacctattgtaattttcatcattttatcctcattcgaatattctacaaaaacaagaatatacaatgtgttacaagaagaaaaaaaaatgcttcaaaaagagaatgtatatgcagcctgcctttaaaagaatcacatttgagacaacaggggataatgtgatgaattgcaaatttgccttttagcttccttccccatgattcagtgatcactgtcacgggaaacccttttatattcatgcttgacattccaagaggcgttcttttcagcctgtggaggagacactcttagatgtgggtttgtgtgtatgggtgcaacacttccggggataggaaagaagaacagttccctaacacaagctgttaagaagtctgtgtagcatctctgataacgaatagacccacaagctcctggaagctgtcgtgtgtccaatgcgtgaaaatgtccgtgacattttcagtgttagtcttgaactaaggcccttgtctgtgtgttttgaaggtgggtaaacctcagagaatgaacctgttatgatttggggtaagaatcacgttggaaaacctctcgcaaccagcacactaggccttctacggccatttccgtaaggggacagagcttaggtaaaggcacacactcatacacacacaacaaagggccctgctaacttactcctcatgctgcttcagtgacctttgttcatgtcacattcctggcgctggaaaaaaaactcaaaggttgattggtttgctttttcaccttggacacatttgcattttacccacaaggcaaacaaaagaatcaggaagtaaaaaatggttgggagtgggacaggtatggtactgaatttttaatgaacattgtaaatgaagaggcttgaatgacagcccaaatctagagaaggcactcagcaagaccaaccaaaagaaaagctgtgtcgtggtatggggccaccgtgatcagctacctggggcaggatgcttctgagacaggcctttcaactgcttagtgttagtatgtccttgcttatgaaaatggggacactcatcagtacgttaactactaaaggggagatggttctccaaccactccataaaatatgtatgttctgttgttcctaaggctttgataatatcctgtacagattttggtttagttttgcaaatatattgctaataggtcactcttatagattattgcttggcccttcaaactcagtacacacacactgaggccctttgacctagtgttttatggaactatttgctttgagagaaaaaaaaaagaaagttttttaaactctttgcattttggattttttttcctaagattttaggatgaatgtgaaaaagatgttagaataacaggaagacaactccagggctgagttttatcagcaattgggtataaatttaaagaccgctgttgcaggatggctctgaattctgttgtgtcgtcttttaaaattttaattattctcatatagtaccgaacagaaaactcagtctagttttaatttgccttttgtgctctaaagaagcattgtacatacaacactagatccagcccctcgattatctgtttggtttcaagtgaatgaaaagatttcctggtaagatcattggatttacagaatacaaaaatgtacgggatggaataaacctagaaagtgaatgct

SEQ ID NO: 435470 - DNA, 4590 bp, Homo sapiens
ggtccttctattaccctgtggttggggtaatagcaggcctcccttcccttcttgggcttttcggagatggtcatttttttgacagacacggcgtgaggaccttcactgattaccacagactcccacagagtcatttgccccgccgtgtcctcctacaggcgggggagccaccctcagaggagctggtgaccctcctaccttgaactgcactgcttcagccacaccagtgaggcaggcattccctggcatgagaaagcgtctggctccctctggtgacaagaggaagcacctgagcctttgccgccatttccactggtggtggagcacgaggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagtgagttctttgcctctactctgaccctagacaacctggggagggaccctgtgcccgcaaaccagacacataggacaaagtttatctataacctggaagaccatgagtggtgtgaaaacatggagtccgttttatagtgactaaaggagggctgaactctgtattagtaatccaagggtcatttttttcttaaaaaaagaaaaaaaggttccaaaaaaaaccaaaactcagtacacacacacaggcacagatgcacacacacgcagacagacacaccgactttgtcctttttctcagcatcagagccagacaggattcagaataaggagagaatgacatcgtgcggcagggtcctggaggccactcgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaaaaaaataaaaaaaaaaaacccacaagttgaaaacattgccagattaagcactagtgacacaccccgtgccaccctcttcctccaggtgggggtgggggcgggcgcacaagtcggaggggtggaagcaccactcctctctctgactttcgcaatatgggtcactgtgtagacgactcacccagtctgcatgtggttcaaggccccagagttctctcagtgatgctaatgggtgatccgtgctggagtttgtaattggcacctctcaccagctccatttccatgttcaagactgagggcctgagggggagccaggtggggggccagcacctcccagtggcgggcatccaccttcccccagccccacagagtgacctcaggaagcagtaggcctcgcctggctatgactgacccggctcagagctggtgagacccaacgcagtccaagtcatttgcttacatttgccaaaaacattttgccatttttaaaagaaaaaaatacaatccatatgaattttaaactgttgtatgtataatcctctaatactatttttaactacttctaaaatctgtgttaacccttcaagtcactaacacagttctctaggccggatttattatgctggttgcttttactttttttctccttttttaatgcaccaaaaatatgtgatacaagggatgcaattaacctattgtaattttcatcattttatcctcattcgaatattctacaaaaacaagaatatacaatgtgttacaagaagaaaaaaaaatgcttcaaaaagagaatgtatatgcagcctgcctttaaaagaatcacatttgagacaacaggggataatgtgatgaattgcaaatttgccttttagcttccttccccatgattcagtgatcactgtcacgggaaacccttttatattcatgcttgacattccaagaggcgttcttttcagcctgtggaggagacactcttagatgtgggtttgtgtgtatgggtgcaacacttccggggataggaaagaagaacagttccctaacacaagctgttaagaagtctgtgtagcatctctgataacgaatagacccacaagctcctggaagctgtcgtgtgtccaatgcgtgaaaatgtccgtgacattttcagtgttagtcttgaactaaggcccttgtctgtgtgttttgaaggtgggtaaacctcagagaatgaacctgttatgatttggggtaagaatcacgttggaaaacctctcgcaaccagcacactaggccttctacggccatttccgtaaggggacagagcttaggtaaaggcacacactcatacacacacaacaaagggccctgctaacttactcctcatgctgcttcagtgacctttgttcatgtcacattcctggcgctggaaaaaaaactcaaaggttgattggtttgctttttcaccttggacacatttgcattttacccacaaggcaaacaaaagaatcaggaagtaaaaaatggttgggagtgggacaggtatggtactgaatttttaatgaacattgtaaatgaagaggcttgaatgacagcccaaatctagagaaggcactcagcaagaccaaccaaaagaaaagctgtgtcgtggtatggggccaccgtgatcagctacctggggcaggatgcttctgagacaggcctttcaactgcttagtgttagtatgtccttgcttatgaaaatggggacactcatcagtacgttaactactaaaggggagatggttctccaaccactccataaaatatgtatgttctgttgttcctaaggctttgataatatcctgtacagattttggtttagttttgcaaatatattgctaataggtcactcttatagattattgcttggcccttcaaactcagtacacacacactgaggccctttgacctagtgttttatggaactatttgctttgagagaaaaaaaaaagaaagttttttaaactctttgcattttggattttttttcctaagattttaggatgaatgtgaaaaagatgttagaataacaggaagacaactccagggctgagttttatcagcaattgggtataaatttaaagaccgctgttgcaggatggctctgaattctgttgtgtcgtcttttaaaattttaattattctcatatagtaccgaacagaaaactcagtctagttttaatttgccttttgtgctctaaagaagcattgtacatacaacactagatccagcccctcgattatctgtttggtttcaagtgaatgaaaagatttcctggtaagatcattggatttacagaatacaaaaatgtacgggatggaataaacctagaaagtgaatgct

SEQ ID NO: 435471 - DNA, 5224 bp, Homo sapiens
  misc_feature (156)..(156): n is a, c, g, or t
  misc_feature (162)..(162): n is a, c, g, or t
ggcggcggcggcggcggcgaagaactgttccttccacctcttcagccccggcaggacgggggcggccgccgcgaacccggggcggggacagcacgcagcctcgaggcgcgcacccccgcccggcagcggccccgacacccggggcgagcgggaaancggcancggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggacccagtaagattaaccaccattattgttaatgtgaaggccggcaaagacatcagatcctgtgacatcatcaacttttttgctggcctagcaagggcaatggggatacaatggggacatcacaggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagtgagttctttgcctctactctgaccctagacaacctggggagggaccctgtgcccgcaaaccagacacataggacaaagtttatctataacctggaagaccatgagtggtgtgaaaacatggagtccgttttatagtgactaaaggagggctgaactctgtattagtaatccaagggtcatttttttcttaaaaaaagaaaaaaaggttccaaaaaaaaccaaaactcagtacacacacacaggcacagatgcacacacacgcagacagacacaccgactttgtcctttttctcagcatcagagccagacaggattcagaataaggagagaatgacatcgtgcggcagggtcctggaggccactcgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaaaaaaataaaaaaaaaaaacccacaagttgaaaacattgccagattaagcactagtgacacaccccgtgccaccctcttcctccaggtgggggtgggggcgggcgcacaagtcggaggggtggaagcaccactcctctctctgactttcgcaatatgggtcactgtgtagacgactcacccagtctgcatgtggttcaaggccccagagttctctcagtgatgctaatgggtgatccgtgctggagtttgtaattggcacctctcaccagctccatttccatgttcaagactgagggcctgagggggagccaggtggggggccagcacctcccagtggcgggcatccaccttcccccagccccacagagtgacctcaggaagcagtaggcctcgcctggctatgactgacccggctcagagctggtgagacccaacgcagtccaagtcatttgcttacatttgccaaaaacattttgccatttttaaaagaaaaaaatacaatccatatgaattttaaactgttgtatgtataatcctctaatactatttttaactacttctaaaatctgtgttaacccttcaagtcactaacacagttctctaggccggatttattatgctggttgcttttactttttttctccttttttaatgcaccaaaaatatgtgatacaagggatgcaattaacctattgtaattttcatcattttatcctcattcgaatattctacaaaaacaagaatatacaatgtgttacaagaagaaaaaaaaatgcttcaaaaagagaatgtatatgcagcctgcctttaaaagaatcacatttgagacaacaggggataatgtgatgaattgcaaatttgccttttagcttccttccccatgattcagtgatcactgtcacgggaaacccttttatattcatgcttgacattccaagaggcgttcttttcagcctgtggaggagacactcttagatgtgggtttgtgtgtatgggtgcaacacttccggggataggaaagaagaacagttccctaacacaagctgttaagaagtctgtgtagcatctctgataacgaatagacccacaagctcctggaagctgtcgtgtgtccaatgcgtgaaaatgtccgtgacattttcagtgttagtcttgaactaaggcccttgtctgtgtgttttgaaggtgggtaaacctcagagaatgaacctgttatgatttggggtaagaatcacgttggaaaacctctcgcaaccagcacactaggccttctacggccatttccgtaaggggacagagcttaggtaaaggcacacactcatacacacacaacaaagggccctgctaacttactcctcatgctgcttcagtgacctttgttcatgtcacattcctggcgctggaaaaaaaactcaaaggttgattggtttgctttttcaccttggacacatttgcattttacccacaaggcaaacaaaagaatcaggaagtaaaaaatggttgggagtgggacaggtatggtactgaatttttaatgaacattgtaaatgaagaggcttgaatgacagcccaaatctagagaaggcactcagcaagaccaaccaaaagaaaagctgtgtcgtggtatggggccaccgtgatcagctacctggggcaggatgcttctgagacaggcctttcaactgcttagtgttagtatgtccttgcttatgaaaatggggacactcatcagtacgttaactactaaaggggagatggttctccaaccactccataaaatatgtatgttctgttgttcctaaggctttgataatatcctgtacagattttggtttagttttgcaaatatattgctaataggtcactcttatagattattgcttggcccttcaaactcagtacacacacactgaggccctttgacctagtgttttatggaactatttgctttgagagaaaaaaaaaagaaagttttttaaactctttgcattttggattttttttcctaagattttaggatgaatgtgaaaaagatgttagaataacaggaagacaactccagggctgagttttatcagcaattgggtataaatttaaagaccgctgttgcaggatggctctgaattctgttgtgtcgtcttttaaaattttaattattctcatatagtaccgaacagaaaactcagtctagttttaatttgccttttgtgctctaaagaagcattgtacatacaacactagatccagcccctcgattatctgtttggtttcaagtgaatgaaaagatttcctggtaagatcattggatttacagaatacaaaaatgtacgggatggaataaacctagaaagtgaatgct

SEQ ID NO: 435472 - DNA, 4802 bp, Homo sapiens
  misc_feature (156)..(156): n is a, c, g, or t
  misc_feature (162)..(162): n is a, c, g, or t
ggcggcggcggcggcggcgaagaactgttccttccacctcttcagccccggcaggacgggggcggccgccgcgaacccggggcggggacagcacgcagcctcgaggcgcgcacccccgcccggcagcggccccgacacccggggcgagcgggaaancggcancggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccacatcagagccagacaggattcagaataaggagagaatgacatcgtgcggcagggtcctggaggccactcgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaaaaaaataaaaaaaaaaaacccacaagttgaaaacattgccagattaagcactagtgacacaccccgtgccaccctcttcctccaggtgggggtgggggcgggcgcacaagtcggaggggtggaagcaccactcctctctctgactttcgcaatatgggtcactgtgtagacgactcacccagtctgcatgtggttcaaggccccagagttctctcagtgatgctaatgggtgatccgtgctggagtttgtaattggcacctctcaccagctccatttccatgttcaagactgagggcctgagggggagccaggtggggggccagcacctcccagtggcgggcatccaccttcccccagccccacagagtgacctcaggaagcagtaggcctcgcctggctatgactgacccggctcagagctggtgagacccaacgcagtccaagtcatttgcttacatttgccaaaaacattttgccatttttaaaagaaaaaaatacaatccatatgaattttaaactgttgtatgtataatcctctaatactatttttaactacttctaaaatctgtgttaacccttcaagtcactaacacagttctctaggccggatttattatgctggttgcttttactttttttctccttttttaatgcaccaaaaatatgtgatacaagggatgcaattaacctattgtaattttcatcattttatcctcattcgaatattctacaaaaacaagaatatacaatgtgttacaagaagaaaaaaaaatgcttcaaaaagagaatgtatatgcagcctgcctttaaaagaatcacatttgagacaacaggggataatgtgatgaattgcaaatttgccttttagcttccttccccatgattcagtgatcactgtcacgggaaacccttttatattcatgcttgacattccaagaggcgttcttttcagcctgtggaggagacactcttagatgtgggtttgtgtgtatgggtgcaacacttccggggataggaaagaagaacagttccctaacacaagctgttaagaagtctgtgtagcatctctgataacgaatagacccacaagctcctggaagctgtcgtgtgtccaatgcgtgaaaatgtccgtgacattttcagtgttagtcttgaactaaggcccttgtctgtgtgttttgaaggtgggtaaacctcagagaatgaacctgttatgatttggggtaagaatcacgttggaaaacctctcgcaaccagcacactaggccttctacggccatttccgtaaggggacagagcttaggtaaaggcacacactcatacacacacaacaaagggccctgctaacttactcctcatgctgcttcagtgacctttgttcatgtcacattcctggcgctggaaaaaaaactcaaaggttgattggtttgctttttcaccttggacacatttgcattttacccacaaggcaaacaaaagaatcaggaagtaaaaaatggttgggagtgggacaggtatggtactgaatttttaatgaacattgtaaatgaagaggcttgaatgacagcccaaatctagagaaggcactcagcaagaccaaccaaaagaaaagctgtgtcgtggtatggggccaccgtgatcagctacctggggcaggatgcttctgagacaggcctttcaactgcttagtgttagtatgtccttgcttatgaaaatggggacactcatcagtacgttaactactaaaggggagatggttctccaaccactccataaaatatgtatgttctgttgttcctaaggctttgataatatcctgtacagattttggtttagttttgcaaatatattgctaataggtcactcttatagattattgcttggcccttcaaactcagtacacacacactgaggccctttgacctagtgttttatggaactatttgctttgagagaaaaaaaaaagaaagttttttaaactctttgcattttggattttttttcctaagattttaggatgaatgtgaaaaagatgttagaataacaggaagacaactccagggctgagttttatcagcaattgggtataaatttaaagaccgctgttgcaggatggctctgaattctgttgtgtcgtcttttaaaattttaattattctcatatagtaccgaacagaaaactcagtctagttttaatttgccttttgtgctctaaagaagcattgtacatacaacactagatccagcccctcgattatctgtttggtttcaagtgaatgaaaagatttcctggtaagatcattggatttacagaatacaaaaatgtacgggatggaataaacctagaaagtgaatgct

SEQ ID NO: 435473 - DNA, 4927 bp, Homo sapiens
  misc_feature (156)..(156): n is a, c, g, or t
  misc_feature (162)..(162): n is a, c, g, or t
ggcggcggcggcggcggcgaagaactgttccttccacctcttcagccccggcaggacgggggcggccgccgcgaacccggggcggggacagcacgcagcctcgaggcgcgcacccccgcccggcagcggccccgacacccggggcgagcgggaaancggcancggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggacccagtaagattaaccaccattattgttaatgtgaaggccggcaaagacatcagatcctgtgacatcatcaacttttttgctggcctagcaagggcaatggggatacaatggggacatcacaggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccacatcagagccagacaggattcagaataaggagagaatgacatcgtgcggcagggtcctggaggccactcgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaaaaaaataaaaaaaaaaaacccacaagttgaaaacattgccagattaagcactagtgacacaccccgtgccaccctcttcctccaggtgggggtgggggcgggcgcacaagtcggaggggtggaagcaccactcctctctctgactttcgcaatatgggtcactgtgtagacgactcacccagtctgcatgtggttcaaggccccagagttctctcagtgatgctaatgggtgatccgtgctggagtttgtaattggcacctctcaccagctccatttccatgttcaagactgagggcctgagggggagccaggtggggggccagcacctcccagtggcgggcatccaccttcccccagccccacagagtgacctcaggaagcagtaggcctcgcctggctatgactgacccggctcagagctggtgagacccaacgcagtccaagtcatttgcttacatttgccaaaaacattttgccatttttaaaagaaaaaaatacaatccatatgaattttaaactgttgtatgtataatcctctaatactatttttaactacttctaaaatctgtgttaacccttcaagtcactaacacagttctctaggccggatttattatgctggttgcttttactttttttctccttttttaatgcaccaaaaatatgtgatacaagggatgcaattaacctattgtaattttcatcattttatcctcattcgaatattctacaaaaacaagaatatacaatgtgttacaagaagaaaaaaaaatgcttcaaaaagagaatgtatatgcagcctgcctttaaaagaatcacatttgagacaacaggggataatgtgatgaattgcaaatttgccttttagcttccttccccatgattcagtgatcactgtcacgggaaacccttttatattcatgcttgacattccaagaggcgttcttttcagcctgtggaggagacactcttagatgtgggtttgtgtgtatgggtgcaacacttccggggataggaaagaagaacagttccctaacacaagctgttaagaagtctgtgtagcatctctgataacgaatagacccacaagctcctggaagctgtcgtgtgtccaatgcgtgaaaatgtccgtgacattttcagtgttagtcttgaactaaggcccttgtctgtgtgttttgaaggtgggtaaacctcagagaatgaacctgttatgatttggggtaagaatcacgttggaaaacctctcgcaaccagcacactaggccttctacggccatttccgtaaggggacagagcttaggtaaaggcacacactcatacacacacaacaaagggccctgctaacttactcctcatgctgcttcagtgacctttgttcatgtcacattcctggcgctggaaaaaaaactcaaaggttgattggtttgctttttcaccttggacacatttgcattttacccacaaggcaaacaaaagaatcaggaagtaaaaaatggttgggagtgggacaggtatggtactgaatttttaatgaacattgtaaatgaagaggcttgaatgacagcccaaatctagagaaggcactcagcaagaccaaccaaaagaaaagctgtgtcgtggtatggggccaccgtgatcagctacctggggcaggatgcttctgagacaggcctttcaactgcttagtgttagtatgtccttgcttatgaaaatggggacactcatcagtacgttaactactaaaggggagatggttctccaaccactccataaaatatgtatgttctgttgttcctaaggctttgataatatcctgtacagattttggtttagttttgcaaatatattgctaataggtcactcttatagattattgcttggcccttcaaactcagtacacacacactgaggccctttgacctagtgttttatggaactatttgctttgagagaaaaaaaaaagaaagttttttaaactctttgcattttggattttttttcctaagattttaggatgaatgtgaaaaagatgttagaataacaggaagacaactccagggctgagttttatcagcaattgggtataaatttaaagaccgctgttgcaggatggctctgaattctgttgtgtcgtcttttaaaattttaattattctcatatagtaccgaacagaaaactcagtctagttttaatttgccttttgtgctctaaagaagcattgtacatacaacactagatccagcccctcgattatctgtttggtttcaagtgaatgaaaagatttcctggtaagatcattggatttacagaatacaaaaatgtacgggatggaataaacctagaaagtgaatgct

SEQ ID NO: 435474 - DNA, 2609 bp, Homo sapiens
  misc_feature (156)..(156): n is a, c, g, or t
  misc_feature (162)..(162): n is a, c, g, or t
ggcggcggcggcggcggcgaagaactgttccttccacctcttcagccccggcaggacgggggcggccgccgcgaacccggggcggggacagcacgcagcctcgaggcgcgcacccccgcccggcagcggccccgacacccggggcgagcgggaaancggcancggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcacagagtaccaagacattgagactgagaaaacctgccccgaatcacattcaccttcagaagactcctttgtgagaagctgagggcctggccctcttcctcttcctggagagaacagccctccaccacccacagacctcgcgggcctcacttagcgtgctcctccctgtccgagaacccgagggtccccatgtggattatccagccagtgtgtggtcctttgaggccccaagcgcaggcctgtgatgaggaccaaagaggtgacttatggtcaggagtactccaaacagctctcagagtaggcatctttcctgggtctctaaagagtcatgctgacctggtgtgcaaattcccttccacccatccctctacctcctctggggatggcttgccgacatgctttagaaactcccctcttgggaatgctcctctgactgagggctccaacagctttaatgaaatcagccgagagggtaaaaaccaacctgttgcatagaatggaggggggaaaaagcacatactcaatagatttttgagtgtggtactctgtatttttgcagcatttattttccaaatgagcagtttagaaatatgtgatgtaaagtacatactgtacgtttgctgaaaattatattaaaagcactattttaattcttaaaatgt

SEQ ID NO: 435475 - DNA, 482 bp, Homo sapiens
aaaaccctattgtgcgcctccccttatgagctgtgaacctaaattgaggcagtgagtggggcattgagtgggatctcgtgtgagctgctttttggaagccaagagtgaatatacccggtgaaaatctacctctgaacagtaaacatttccttgtgcttctttcagcacaccttagcagtgctgccaagccagttttagcctaaattcagagaacgtctggcttctcactgtttttgtttagaccgatataaacacagggtagacaagaaaattaaggagggaatgtgatcagcctccggctttgagagaaacagaaccgctggtgtggaacaataggcttcgtagcctggcagccagtgttcccgaccgcaagtcatttctagagcccttgccctctctgttcagcggattcagattctcagcaaaatccccagtggtccagccttcttttctccactaagctgtgctctttccatttacag

SEQ ID NO: 435476 - DNA, 178 bp, Homo sapiens
cgagcaggccatgctctccgaaagagaatacgagagacccaagcccagcaacggggtcctgaggcaccccctggagccagacagcagtgcctcctgtttccagcagctgagaggtaaaggtggcctcatctgcctctgctcagaacagtagggggattgggatgggggtgatgagtga

SEQ ID NO: 435477 - DNA, 426 bp, Homo sapiens
atgctttctatgtgtaaagttagtcttcacagccatctggtgaagactgtagtattatcatcatccccattttgcagatgaggaaactaaggcaggagggcttaaataacttgctcagatttgtaccataataaaaaggcagaactgggacacaaactcatgcgctttgcctcctgagcatgtctttgagccacggagtcagacatatttgcctagcagtgctataagaaaagctaggcagagacaggaacaggggagcactggccaccagatccagaaccttaacattcttttcccggtaacaggcttcatccctccacccctcatcttcggggctggcatcgactccacctgcctgttctggagcacgttctgtggggagcaaggcgcctgcgtcctctacgacaatgtggtctaccgatacct

SEQ ID NO: 435478 - DNA, 342 bp, Homo sapiens
aaaaaaggttccaaaaaaaaccaaaactcagtacacacacacaggcacagatgcacacacacgcagacagacacaccgactttgtcctttttctcagcatcagagccagacaggattcagaataaggagagaatgacatcgtgcggcagggtcctggaggccactcgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcc

SEQ ID NO: 435479 - DNA, 4553 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaatccaacctctataatctgttggccagtgaaaatacttttgggctgggcacggtggctcacgcctgtaatcccagcactttgggaggccaaggtgggcggataacctgaggtcaggagtttgagaccagcgtggctaacacggtgaaaccccgtctctactaaaaatagaaaaattaagctgggcatggtggtgcatgcctgtaattccagcggcttggaaggctgaggcaggagaatcacttgaacttgggaggtggaggttgcagtgagccaagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttcttttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435480 - DNA, 5213 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccaggttaaataaaataccctgttttcctatcttcaccttattcttctactatattctccctttaaaaaagataaattcacatcattctcccagtactaggatttctgctttctggaattcattttggttaggttttttatcctattcaacagactcttgaaagcctctgagagttcttactttcttatacatctcactcaaagctcttgatctaccagtatgtggtttgtatttaaaaccttggctttcagtggtgctctctcttttaccctccacctaaaaaagagagtgatatctccctccagtctccccacccctcaagactgctagaaaaggagtgattctgtacatgtaattgtaaagttagccactaaagttaaaaagattcttaatttgtagttttggtgcaattttatcagaagtacctttccattttgccagaatccttgaatcattctttaaaccaaagcatttttttatagtttctagctaggtttatagaaactagtggagctatgggcagtcagttaaaaacaggccatagatagcataatgaattataacacccctgtccaagtcctatagagaaaaaaaaaaatccctacttttgactacagttacacagcagatcccaaagagctttgtagtagtttaacgtactacaacttatcagaaagatgaggcacttgacagttacattaaggagctaaagtcaatacggcagttgtagatttgctaatgccactgtatttttctgctcatagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaatccaacctctataatctgttggccagtgaaaatacttttgggctgggcacggtggctcacgcctgtaatcccagcactttgggaggccaaggtgggcggataacctgaggtcaggagtttgagaccagcgtggctaacacggtgaaaccccgtctctactaaaaatagaaaaattaagctgggcatggtggtgcatgcctgtaattccagcggcttggaaggctgaggcaggagaatcacttgaacttgggaggtggaggttgcagtgagccaagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttcttttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435481 - DNA, 5253 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcaggttcatgctgaatactctagatttgtgaatcagattaatactgctgtacctttaccaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccaggttaaataaaataccctgttttcctatcttcaccttattcttctactatattctccctttaaaaaagataaattcacatcattctcccagtactaggatttctgctttctggaattcattttggttaggttttttatcctattcaacagactcttgaaagcctctgagagttcttactttcttatacatctcactcaaagctcttgatctaccagtatgtggtttgtatttaaaaccttggctttcagtggtgctctctcttttaccctccacctaaaaaagagagtgatatctccctccagtctccccacccctcaagactgctagaaaaggagtgattctgtacatgtaattgtaaagttagccactaaagttaaaaagattcttaatttgtagttttggtgcaattttatcagaagtacctttccattttgccagaatccttgaatcattctttaaaccaaagcatttttttatagtttctagctaggtttatagaaactagtggagctatgggcagtcagttaaaaacaggccatagatagcataatgaattataacacccctgtccaagtcctatagagaaaaaaaaaaatccctacttttgactacagttacacagcagatcccaaagagctttgtagtagtttaacgtactacaacttatcagaaagatgaggcacttgacagttacattaaggagctaaagtcaatacggcagttgtagatttgctaatgccactgtatttttctgctcatagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaatccaacctctataatctgttggccagtgaaaatacttttgggctgggcacggtggctcacgcctgtaatcccagcactttgggaggccaaggtgggcggataacctgaggtcaggagtttgagaccagcgtggctaacacggtgaaaccccgtctctactaaaaatagaaaaattaagctgggcatggtggtgcatgcctgtaattccagcggcttggaaggctgaggcaggagaatcacttgaacttgggaggtggaggttgcagtgagccaagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttcttttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435482 - DNA, 4397 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctccttcccaagtcagccccaggcacagaagagacgattcacagaggagctaccagatgaacgggaatctggactgcttggataccagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaatccaacctctataatctgttggccagtgaaaatacttttgggctgggcacggtggctcacgcctgtaatcccagcactttgggaggccaaggtgggcggataacctgaggtcaggagtttgagaccagcgtggctaacacggtgaaaccccgtctctactaaaaatagaaaaattaagctgggcatggtggtgcatgcctgtaattccagcggcttggaaggctgaggcaggagaatcacttgaacttgggaggtggaggttgcagtgagccaagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttcttttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435483 - DNA, 3660 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccaggttaaataaaataccctgttttcctatcttcaccttattcttctactatattctccctttaaaaaagataaattcacatcattctcccagtactaggatttctgctttctggaattcattttggttaggttttttatcctattcaacagactcttgaaagcctctgagagttcttactttcttatacatctcactcaaagctcttgatctaccagtatgtggtttgtatttaaaaccttggctttcagtggtgctctctcttttaccctccacctaaaaaagagagtgatatctccctccagtctccccacccctcaagactgctagaaaaggagtgattctgtacatgtaattgtaaagttagccactaaagttaaaaagattcttaatttgtagttttggtgcaattttatcagaagtacctttccattttgccagaatccttgaatcattctttaaaccaaagcatttttttatagtttctagctaggtttatagaaactagtggagctatgggcagtcagttaaaaacaggccatagatagcataatgaattataacacccctgtccaagtcctatagagaaaaaaaaaaatccctacttttgactacagttacacagcagatcccaaagagctttgtagtagtttaacgtactacaacttatcagaaagatgaggcacttgacagttacattaaggagctaaagtcaatacggcagttgtagatttgctaatgccactgtatttttctgctcatagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatgattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435484 - DNA, 5159 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccaggttaaataaaataccctgttttcctatcttcaccttattcttctactatattctccctttaaaaaagataaattcacatcattctcccagtactaggatttctgctttctggaattcattttggttaggttttttatcctattcaacagactcttgaaagcctctgagagttcttactttcttatacatctcactcaaagctcttgatctaccagtatgtggtttgtatttaaaaccttggctttcagtggtgctctctcttttaccctccacctaaaaaagagagtgatatctccctccagtctccccacccctcaagactgctagaaaaggagtgattctgtacatgtaattgtaaagttagccactaaagttaaaaagattcttaatttgtagttttggtgcaattttatcagaagtacctttccattttgccagaatccttgaatcattctttaaaccaaagcatttttttatagtttctagctaggtttatagaaactagtggagctatgggcagtcagttaaaaacaggccatagatagcataatgaattataacacccctgtccaagtcctatagagaaaaaaaaaaatccctacttttgactacagttacacagcagatcccaaagagctttgtagtagtttaacgtactacaacttatcagaaagatgaggcacttgacagttacattaaggagctaaagtcaatacggcagttgtagatttgctaatgccactgtatttttctgctcatagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaatccaacctctataatctgttggccagtgaaaatacttttgggctgggcacggtggctcacgcctgtaatcccagcactttgggaggccaaggtgggcggataacctgaggtcaggagtttgagaccagcgtggctaacacggtgaaaccccgtctctactaaaaatagaaaaattaagctgggcatggtggtgcatgcctgtaattccagcggcttggaaggctgaggcaggagaatcacttgaacttgggaggtggaggttgcagtgagccaagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttcttttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435485 - DNA, 2844 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctccttcccaagtcagccccaggcacagaagagacgattcacagaggagctaccagatgaacgggaatctggactgcttggataccagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatgattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435486 - DNA, 2871 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatgattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435487 - DNA, 5132 bp, Homo sapiens
cgggctgcaggaattggcacgaggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggttcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcaggttcatgctgaatactctagatttgtgaatcagattaatactgctgtacctttaccaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccaggttaaataaaataccctgttttcctatcttcaccttattcttctactatattctccctttaaaaaagataaattcacatcattctcccagtactaggatttctgctttctggaattcattttggttaggttttttatcctattcaacagactcttgaaagcctctgagagttcttactttcttatacatctcactcaaagctcttgatctaccagtatgtggtttgtatttaaaaccttggctttcagtggtgctctctcttttaccctccacctaaaaaagagagtgatatctccctccagtctccccacccctcaagactgctagaaaaggagtgattctgtacatgtaattgtaaagttagccactaaagttaaaaagattcttaatttgtagttttggtgcaattttatcagaagtacctttccattttgccagaatccttgaatcattctttaaaccaaagcatttttttatagtttctagctaggtttatagaaactagtggagctatgggcagtcagttaaaaacaggccatagatagcataatgaattataacacccctgtccaagtcctatagagaaaaaaaaaaatccctacttttgactacagttacacagcagatcccaaagagctttgtagtagtttaacgtactacaacttatcagaaagatgaggcacttgacagttacattaaggagctaaagtcaatacggcagttgtagatttgctaatgccactgtatttttctgctcatagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaatccaacctctataatctgttggccagtgaaaatacttttgggctgggcacggtggctcacgcctgtaatcccagcactttgggaggccaaggtgggcggataacctgaggtcaggagtttgagaccagcgtggctaacacggtgaaaccccgtctctactaaaaatagaaaaattaagctgggcatggtggtgcatgcctgtaattccagcggcttggaaggctgaggcaggagaatcacttgaacttgggaggtggaggttgcagtgagccaagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttcttttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435488 - DNA, 5036 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcaggttcatgctgaatactctagatttgtgaatcagattaatactgctgtacctttaccaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccaggttaaataaaataccctgttttcctatcttcaccttattcttctactatattctccctttaaaaaagataaattcacatcattctcccagtactaggatttctgctttctggaattcattttggttaggttttttatcctattcaacagactcttgaaagcctctgagagttcttactttcttatacatctcactcaaagctcttgatctaccagtatgtggtttgtatttaaaaccttggctttcagtggtgctctctcttttaccctccacctaaaaaagagagtgatatctccctccagtctccccacccctcaagactgctagaaaaggagtgattctgtacatgtaattgtaaagttagccactaaagttaaaaagattcttaatttgtagttttggtgcaattttatcagaagtacctttccattttgccagaatccttgaatcattctttaaaccaaagcatttttttatagtttctagctaggtttatagaaactagtggagctatgggcagtcagttaaaaacaggccatagatagcataatgaattataacacccctgtccaagtcctatagagaaaaaaaaaaatccctacttttgactacagttacacagcagatcccaaagagctttgtagtagtttaacgtactacaacttatcagaaagatgaggcacttgacagttacattaaggagctaaagtcaatacggcagttgtagatttgctaatgccactgtatttttctgctcatagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaatccaacctctataatctgttggccagtgaaaatacttttgggctgggcacggtggctcacgcctgtaatcccagcactttgggaggccaaggtgggcggataacctgaggtcaggagtttgagaccagcgtggctaacacggtgaaaccccgtctctactaaaaatagaaaaattaagctgggcatggtggtgcatgcctgtaattccagcggcttggaaggctgaggcaggagaatcacttgaacttgggaggtggaggttgcagtgagccaagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttcttttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435489 - DNA, 4830 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggtcaccccaaaccagaaggcctggctgctgccaagaagctttgtgagaatcttttgcaaacagttcatgctgaatactctagatttgtgaatcagattaatactgctgtacctttaccaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctccttcccaagtcagccccaggcacagaagagacgattcacagaggagctaccagatgaacgggaatctggactgcttggataccaggttaaataaaataccctgttttcctatcttcaccttattcttctactatattctccctttaaaaaagataaattcacatcattctcccagtactaggatttctgctttctggaattcattttggttaggttttttatcctattcaacagactcttgaaagcctctgagagttcttactttcttatacatctcactcaaagctcttgatctaccagtatgtggtttgtatttaaaaccttggctttcagtggtgctctctcttttaccctccacctaaaaaagagagtgatatctccctccagtctccccacccctcaagactgctagaaaaggagtgattctgtacatgtaattgtaaagttagccactaaagttaaaaagattcttaatttgtagttttggtgcaattttatcagaagtacctttccattttgccagaatccttgaatcattctttaaaccaaagcatttttttatagtttctagctaggtttatagaaactagtggagctatgggcagtcagttaaaaacaggccatagatagcataatgaattataacacccctgtccaagtcctatagagaaaaaaaaaaatccctacttttgactacagttacacagcagatcccaaagagctttgtagtagtttaacgtactacaacttatcagaaagatgaggcacttgacagttacattaaggagctaaagtcaatacggcagttgtagatttgctaatgccactgtatttttctgctcatagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaatccaacctctataatctgttggccagtgaaaatacttttgggctgggcacggtggctcacgcctgtaatcccagcactttgggaggccaaggtgggcggataacctgaggtcaggagtttgagaccagcgtggctaacacggtgaaaccccgtctctactaaaaatagaaaaattaagctgggcatggtggtgcatgcctgtaattccagcggcttggaaggctgaggcaggagaatcacttgaacttgggaggtggaggttgcagtgagccaagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttcttttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435490 - DNA, 1271 bp, Homo sapiens
tgcgtaagaacgttgggggcggaagtgacgagaggtggtagtcggatagttggcgggtggttgagtagaagcggtcgccatgtccgcggggagcgcgacacatcctggagctggcggggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435491 - DNA, 1014 bp, Homo sapiens
aagcagtggtatcaacgcagagtgcccattacggccgggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435492 - DNA, 2612 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccaggttaaataaaataccctgttttcctatcttcaccttattcttctactatattctccctttaaaaaagataaattcacatcattctcccagtactaggatttctgctttctggaattcattttggttaggttttttatcctattcaacagactcttgaaagcctctgagagttcttactttcttatacatctcactcaaagctcttgatctaccagtatgtggtttgtatttaaaaccttggctttcagtggtgctctctcttttaccctccacctaaaaaagagagtgatatctccctccagtctccccacccctcaagactgctagaaaaggagtgattctgtacatgtaattgtaaagttagccactaaagttaaaaagattcttaatttgtagttttggtgcaattttatcagaagtacctttccattttgccagaatccttgaatcattctttaaaccaaagcatttttttatagtttctagctaggtttatagaaactagtggagctatgggcagtcagttaaaaacaggccatagatagcataatgaattataacacccctgtccaagtcctatagagaaaaaaaaaaatccctacttttgactacagttacacagcagatcccaaagagctttgtagtagtttaacgtactacaacttatcagaaagatgaggcacttgacagttacattaaggagctaaagtcaatacggcagttgtagatttgctaatgccactgtatttttctgctcatagatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435493 - DNA, 806 bp, Homo sapiens
tcgtcaccctgtgtacttttcatgtagctcactccgttctcaccaatcccgagcgacaggcacctgccgccacgactggctaacttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435494 - DNA, 660 bp, Homo sapiens
aaaatgctgtttcattttcctatccaggatccagctatatccaacagttttaaatgagacagcattttccaaaacagaaataatccaaaacaaaacagggatgcagatctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 435495 - DNA, 2003 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccaggttaaataaaataccctgttttcctatcttcaccttattcttctactatattctccctttaaaaaagataaattcacatcattctcccagtactaggatttctgctttctggaattcattttggttaggttttttatcctattcaacagactcttgaaagcctctgagagttcttactttcttatacatctcactcaaagctcttgatctaccagtatgtggtttgtatttaaaaccttggctttcagtggtgctctctcttttaccctccacctaaaaaagagagtgatatctccctccagtctccccacccctcaagactgctagaaaaggagtgattctgtacatgtaattgtaaagttagccactaaagttaaaaagattcttaatttgtagttttggtgcaattttatcagaagtacctttccattttgccagaatccttgaatcattctttaaaccaaagcatttttttatagtttctagctaggtttatagaaactagtggagctatgggcagtcagttaaaaacaggccatagatagcataatgaattataacacccctgtccaagtcctatagaga

SEQ ID NO: 435496 - DNA, 2077 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacaggtaggatgtcaggatatgcaacaacatattactgaatttaggaaaaactggggaaagaggggaagtagtggtattccagaaataaatcatgtgatgtggaatgtctttttcctgctgtcttctgtgttcctaccaccaacctacctgaatattttggattagtgtgtatgtgtgtatgtcatcctgaagtttatattttcacaagtcttgcacaccaaatagctgtttaaagtggggatggtgggcacacttgctataaagggtcagatggcaaatattttaggctttaagggccatacattctctgtcacaactatcacactcggtggttgtagtgcagaagcagcccgtggataatacctcaatgaataagcatagctgttgtactccagtagaactttatttacaaaacaggtggcaggccacagtcatagtttgccatacccttggccattgtttgcctaaccttacctttgcagtgttaacaaagtcctcaaggagaatggggctaccttcaccacacctctcagtaattggaactgagttagcatttcaaatcttagaaggaaacataatctcagcatctggggaggccgaggcaggattgctttagcacagtttgagaccagcctaggcaacatagtgagactccatctctacaaaaaaaattaactggacatggtggcacatacctgtatttcagctacttaagaggctgagatggaagggtcccttgagcctaggaggtcatggatgcagtgaaccaagatggtgccagtgcactccagcctcagtgacagagtgagactgtctcaaaaaaaattttaaaaagc

SEQ ID NO: 435497 - DNA, 1420 bp, Homo sapiens
gccgggcgcggtggcttacgcctgtaatcccagcactttgggaggccgaggcgggtggatcacgaggtcaggagtttgagaccagcctgaccaacatggtgaaaccccgtctctactgaaaatacaaaaattagtcgggcatggtggcacgcgcctgtaatcagctactcaggaggctgaggcagaactgcttgaacccgggaggcggaggttgcagtgagccgagattgtgccagtgcactctagcctgggcgacccaatgagactccgtctcaaaaaaaaattcctaatggctttggtcctagaattatgtaatcagacccttgtaaatgcacagcttcggctgtcccatgttaatttgtttccccctctctttgttcatgctgaatactctagatttgtgaatcagattaatactgctgtacctttaccagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacaggtaggatgtcaggatatgcaacaacatattactgaatttaggaaaaactggggaaagaggggaagtagtggtattccagaaataaatcatgtgatgtggaatgtctttttcctgctgtcttctgtgttcctaccaccaacctacctgaatattttggattagtgtgtatgtgtgtatgtcatcctgaagtttatattttcacaagtcttgcacaccaaatagctgtttaaagtggggatggtgggcacacttgctataaagggtcagatggcaaatattttaggctttaagggccatacattctctgtcacaactatcacactcggtggttgtagtgcagaagcagcccgtggataatacctcaatgaataagcatagctgttgtactccagtagaactttatttacaaaacaggtggcaggccacagtcatagtttgccatacccttggccattgtttgcctaaccttacctttgcagtgttaacaaagtcctcaaggagaatggggctaccttcaccacacctctcagtaattggaactgagttagcatttcaaatcttagaaggaaacataatctcagcatctggggaggccgaggcaggattgctttagcacagtttgagaccagcctaggcaacatagtgagactccatctctacaaaaaaaattaactggacatggtggcacatacctgtatttcagctacttaagaggctgagatggaagggtcccttgagcctaggaggtcatggatgcagtgaaccaagatggtgccagtgcactccagcctcagtgacagagtgagactgtctcaaaaaaaattttaaaaagc

SEQ ID NO: 435498 - DNA, 799 bp, Homo sapiens
tgcgtaagaacgttgggggcggaagtgacgagaggtggtagtcggatagttggcgggtggttgagtagaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagtaagtaatgtttttggctcacgtagcactttttgtgaagagcaaagtacagggctctgtatagcaagttggcaaagtgtccctgatggctgttctaacccttgttcatgaactatacacgaatttgtatgggagtttagagggatggagagccacatatttgggtaacgtataaagcagatttacggtgaataattgaacac

SEQ ID NO: 435499 - DNA, 210 bp, Homo sapiens
ccagttgacttttaaaatcaagaagtttatttgttccccagctgttaaagcatgttctgagacattagctagcaaaaacccttctaatgtatatagtcccttttggttatttggaaacttgaaacattacaaattagatctggtgacccatttgactccttttttggttttgaccacattgagatcatccttttttgtttctctttatag

SEQ ID NO: 435500 - DNA, 390 bp, Homo sapiens
cttgaagtgtttaaaaaatattttgctagtgatagttatgtgtaactatgatacttgaggctagactgtgccagggcactattaatgttccctttaatttagggtaatttggaaagccattcatgcctcagtatttttcttccctagatattaagtttaatattcagctaaattgtctcattctgctgcagctgattaaacactttttttcttccccctcaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggag

SEQ ID NO: 435501 - DNA, 462 bp, Homo sapiens
gctttggggcctaatgttttcctttttctccatgtaggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaaggtatttgaagttgaagggtctccactaattgcgaatttaatagttgttttgccgggcgcggtggcttacgcctgtaatcccagcactttgggaggccgaggcgggtggatcacgaggtcaggagtttgagaccagcctgaccaacatggtgaaaccccgtctctactgaaaatacaaaaattagtcgggcatggtggcacgcgcctgt

SEQ ID NO: 435502 - DNA, 952 bp, Homo sapiens
atgcgcagcaccccggaccggaaacagcgcggggtccgctatggcggcggcagccgagggcgtactggcgacccggagtgatgagcccgcccgagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattcctcggagggcgcacacatattctaaggggggtcagcgccagaaggcccgccggaccagcccgtgcgaacccctcgcccaggaaccaacgcttggaacacgagcgacgcaacacagcaaaaacaaaccgagcacaaacgggaagccggacaccacgcactgcctc

SEQ ID NO: 435503 - DNA, 939 bp, Homo sapiens
cccctggataaaaaattttcatcaagataatcttctcgtttacacgcaacactttttcttagacaccgccgcaatgtttaattactccgttttggtttaacacacccctaagtacccaccctcggaaaggtttgtaattatttctccccctaggagcgcgttttcactaatgtttcgttatggagagtatttgtgcccaccaattatgtttgcgccccccccccgcatgatatggggtcttctgttcctccccagaatttcttctcccccgtgtgtccgctttttgcccagctgcgcaggcgttgtgtttttatcatcgcgccgccgctcgctgctctgtggggtttttattacacgcctccctctttttgggggggcccccttgtttcaacaaaaaacggggggcccgcgcctaaattggggcccccccgcgggggaatttttttggcgcgcggccccccctcttttttttttttttttttttttttttttttttttttttttgtttctcttttttttttttttttttttttttttatggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaata

SEQ ID NO: 435504 - DNA, 1231 bp, Homo sapiens
atgcgcagcaccccggaccggaaacagcgcggggtccgctatggcggcggcagccgagggcgtactggcgacccggagtgatgagcccgcccgagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaata

SEQ ID NO: 435505 - DNA, 1646 bp, Homo sapiens
atgcgcagcaccccggaccggaaacagcgcggggtccgctatggcggcggcagccgagggcgtactggcgacccggagtgatgagcccgcccgagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaataaaaaaaaaaaaaaaaaaaaaaaaaaaaaaaaaacaaaagaacaaagaaaaaaaaaaaaaaaggaccagcaaaaaaaaaaacaagggacccacaatcgacaaaagccagacacgagggcaccaaaataggagcacggtgacccaacacggaccattttcacataaacaaagaagagggtactacatttaaggaggtgctaacgaattaaaaacaaaaacagagcaacacaatcaggcggccactccaaatgcaaaccggaccgacataaaaacgccaacaaacaagcgcgacactaacagaacactaaccgtgtacacatactacctactcatcaacgggccactagcaacacactaacgccaaaaaccccacacaaggaccacaaagagcacccccctccccctggccaacaacc

SEQ ID NO: 435506 - DNA, 1015 bp, Homo sapiens
atgcgcagcaccccggaccggaaacagcgcggggtccgctatggcggcggcagccgagggcgtactggcgacccggagtgatgagcccgcccgagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattcca

SEQ ID NO: 435507 - DNA, 1339 bp, Homo sapiens
atgcgcagcaccccggaccggaaacagcgcggggtccgctatggcggcggcagccgagggcgtactggcgacccggagtgatgagcccgcccgagacgatgccgccgtggagacagctgaggaagcaaaggagcctgctgaagctgacatcactgagctctgccgggacatgttctccaaaatggccacttacctgactggggaactgacggagctcagagattgatcagagcacaagaaacagatttcggagtcactttcgtagtggtgtgattggacgctgtgcaggatgagattgccaaggaagagcttagaagtagccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaata

SEQ ID NO: 435508 - DNA, 1542 bp, Homo sapiens
gggttggcgtctagaggtccccgtcgacggtgtctggtcctctattactttcatgctgaatgatggctcatctctctcggttctctctcccccatatctacactctcatatttatactgctatcaaattagtctctctaaaacaaaggtcacagctagccaccgcgcccagcctgatagtatatatattatatgtatataagttaaatgttttcatgctgtagaagtaccaagactattttacctcccttttcttaggacatgagtttatcatttccctttgtaaccatgatcctgaaccttctggatcttgtttggtttaaatagttttctgattgttgcctgaatttctacctagactttcagagtacataggctgagttataaatgtcatagatcaaaagtggcccactcctttgacacttccttggtcctgccttgaactaccacttagcttatactcccacattctaatgatttaagacaaatcttaaagacattacatcttctgtttaattttcaagccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaata

SEQ ID NO: 435509 - DNA, 1712 bp, Homo sapiens
gagacgggagagggagagggagacgggagagggagacgggagagggagacgggagagggagacgggagagggagacgggagagagagagggagacgggagagggagatggagagggagacgggcctgagtttgtttttgtccttataacatttacagattattttattttcatcatttaacaagggctgactacttcaagaaagtagtttgtagtaggctgggatttgatatgggtggcgattaacaatcagttttattttctacagttacatttagccagtgattaccgtgaaccttaccgcgtagaaggcaggggtaaccttaccatgtagaaagtatcttggttcacagtaaccatttgtgacagagtccctttttctgttaaaattgtgaaaccaggtgctttcatggttttaatagaaaaacggaatgtcagagtaagaggcttatttgatggccttttaaatatctgtatctttcaaaattgctttcctggagtaaggtgtaaggataagaacatacaggaggaaacatacatttatacttcctgagggttccagtctggttccagagggcacctgggacagtgctgagagaggcagttttttagtaaggctcccgataggtcaagtgacagatgtgccccatcctggtggagctgtctaagtaggtgctgttgacagggtgaggacttcgtgaacctgtgttaggctctcagttctgagtgtctgtgcttgaattcttattccaagttttacagatcagtgatccgtatatttggacagatgatgagattgaagctaatagatttttagtaatattatacatattttttaaacttgactggaaatgctaactaaaaactgtctttgtaagagccagttttaaaagatgtaactctccctcatccctcacagaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaata

SEQ ID NO: 435510 - DNA, 925 bp, Homo sapiens
atgcgcagcaccccggaccggaaacagcgcggggtccgctatggcggcggcagccgagggcgtactggcgacccggagtgatgagcccgcccgagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactgggtaaccgtttttacttctgttttgatgtaataaagactgcttcttgccagcatattcttagtaaacataatagttaacatttatggtgtgcctacagtgatctattaatcttcacaaaaccttagtaatttattattatattaataaaaataacatttcctgattacttaatgatatatcaggcactgttcttagtgctttacatgtattatgtttggtttttgtttttggtttgttttttttgagacaagtttcactcttgttgcccaagctggagtgcaatggtgcgatctcggctcaccgcaacccccatctctactaaaaatacaaacattaattgggcgtggtggtgtgtgcctgtaatctgagctactcctgaggccgaggcaggagaattgcttgaacctgggaggtggaggttgcagtgagccaagatggcaccactgcactctagcctgggcaatggagtgagactccgtctcaattta

SEQ ID NO: 435511 - DNA, 1985 bp, Homo sapiens
atgcgcagcaccccggaccggaaacagcgcggggtccgctatggcggcggcagccgagggcgtactggcgacccggagtgatgagcccgcccgagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaataccttcctactgtgtatgtaggatttggggggatcttagggacctaatcgacttctttgcacactaaaaacatcagacaatgggacatactgactgaccagtctaggttgaaagataggcagccttacccagaacacaacattagcagctgggaaggtgtctgaggtccccaattacatatcccaaagagtttcttacttctgtttctgtcatttcccctctgttccagacagtcatcatttatcctctgttcttcctggactgttgctgtggtctcttctcatcttaactgtcccttccaaccaccctccacactgctgccagagcaatcttaaaaatgtaaactggccctattactcctgcttagaaccctgtagtgacttatcatggcctctgaaaaatctagactttcattatgcatacaagtcccttgtgtttttttgtttgtttatagacagggtctctattgtcacccaggctggagtgtggtggtgtgataatagctcaccttgacctcctaggctcaactgatcttcccacctcagcctcctgaatagctgggactaccagcacgctccaccatgccttgctaattattttttatacagatggagtctcactatgttgtccaggctggtcttgaactggcctcaagtgattctcttaccacagcctgccagagtgctgagattgtaggcatgaaccaccgtgcctaacataaggcccctatttaaacatttttcttaaataaaaaa

SEQ ID NO: 435512 - DNA, 1282 bp, Homo sapiens
gcagtgaaggacttgaaattatggcagatggagaatggagccgacttgatggaatgaaggcaagtggagggatgtcggaacaggctgctttggctggattagcaccgggtgtaggcgggacacttagtcattctcccttggcccagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaata

SEQ ID NO: 435513 - DNA, 2481 bp, Homo sapiens
  misc_feature (1586)..(1586): n is a, c, g, or t
  misc_feature (1602)..(1602): n is a, c, g, or t
tgttctgttaaggtacaactactgggccttgaaatctatccttcacaatcttggctgagataaggacttggcacaggatgatagagcctggacacaagagatctggagagggaactgctatttgctgctacattcagattatgagatgtcagggaactgtaaaaagggtaatgaatttttaaagagagtaaagagttatgctgtgtcccggtcaactgaaatacattaaaaattaattagatggtagttcttaactttttaaggcagataccttgagaatctagtgagttatagaccctctccctagaaaagtatagaactgtttatatggacaataattcacatgcattcagagatcttagggatctcctgaatgttttcttggatcccaagtgaaaaattcctgaatcaggtctcttaggtgtgcggttaatgtcatgtataacaatggggggacccttacttatctaaatataattatcccaatcctaataatgatgaggttgcataggaaagtaatagtgtaccaaactttagattattcactaaaaaagttgttcatttatgaagtagtcgtttatcaaacatgtcctccccactcagcaaactatgccttctatttattatatatgggtcagtttcactataattactgagtgttataaacatctgaccataacattttgaaatgatgcaaataaatttccaaacaaaaatagtgtgaatttaaaagcaaattatttgagtatctaagaaacaagatagacttctagaaaaatttgactctctagaatatttcttgcagaaatgagatttttcataatagtaaaagaggcatatgtttatcaaacaatgctgtcacaaaaagcatcaactgtaatgggactattaatgcataattattgatttattcattcaattaatatacaattatcccttttcatttaaagatttaattcataattacaattataataaaacttcctttaaagtaagatacaataattttattgtttttcattcttttttcaacaaaatatcccatccaatcattttttatattattaaatattggctgctttttcttggattcacattaaacagccctttccaacttccaattgtcttaaaataatgatgacctcctgtgagtagatacagctctttacaatttttttctttagtgccttttcttcttgaatttttcctatatcaaatggagaatatatgtacagatggtattttctcagtttataggcatatcagtgaccatggctttctttatataggtttttaaaaaagccctaaataataaatagccagatgagctggggacattgagaaatagtcttcctcttcctttttcaactcatttttttcccacctacatgactgtaaatcaaatatttaatagctcttacttaaaaaaacagatacaaagaatgtcttgatttggtgtgctcatttaccataatgtcatgaggggaattagatttcacaactttaaaaggaatatatttttattttattttgaaaaactgagtcatataggaattttcttatacttcaaggcatcatggaaacanttttttcctgtttggntattgtggaatttaaacgttcaaataaataaatggcataactaagtgttccaaatttttttacaatgtctttgaccctattcaaacactttaggtatttactgaccgtctgatgtgtaagatgtggaataaaactggaatcaattaattatttcactgtgttatcagcgcaagatcaaccatctgggtttcttaaagacacccgaaggattgaattttgtttcagtattgataatggcatagtctctatgtgctacatggaattacatcatttatccctccagtgccctatatgttgataagtatgtcagtttgacttagtatacatatatacagagatttcattacatttacctaataaatacaaaatacatttcgagtgttactgatctcctatgttacatgagcctcctgtaatcattgtgcattgatgttccaatgttttattgtttgtatgaattttaatttgaaaacaaggaaacaatccaaaagcagaaaaaatagcttttcttaaaattttcagtgctacattttccctctgaggtccatagagatttgaatgtataggagattatccgaaaacagctattttgattaaaaaatatatctcccaggattcaaccaacttaatgatgaagtactattgtctactgctttatacataaaagggaactttttatctgcttgtaaagggatttttatgtgtatttctgcataatcagatgacttctattgtgttttctactgatgaaattctctgtaaaatgtctttttcttacattatccaacaggcataaagaataacagtaaagacttttgtgtttgtaatactacctcttttatccctgcactactgttttattgcaaaaattctatattg

SEQ ID NO: 435514 - DNA, 2427 bp, Homo sapiens
  misc_feature (1586)..(1586): n is a, c, g, or t
  misc_feature (1602)..(1602): n is a, c, g, or t
tgttctgttaaggtacaactactgggccttgaaatctatccttcacaatcttggctgagataaggacttggcacaggatgatagagcctggacacaagagatctggagagggaactgctatttgctgctacattcagattatgagatgtcagggaactgtaaaaagggtaatgaatttttaaagagagtaaagagttatgctgtgtcccggtcaactgaaatacattaaaaattaattagatggtagttcttaactttttaaggcagataccttgagaatctagtgagttatagaccctctccctagaaaagtatagaactgtttatatggacaataattcacatgcattcagagatcttagggatctcctgaatgttttcttggatcccaagtgaaaaattcctgaatcaggtctcttaggtgtgcggttaatgtcatgtataacaatggggggacccttacttatctaaatataattatcccaatcctaataatgatgaggttgcataggaaagtaatagtgtaccaaactttagattattcactaaaaaagttgttcatttatgaagtagtcgtttatcaaacatgtcctccccactcagcaaactatgccttctatttattatatatgggtcagtttcactataattactgagtgttataaacatctgaccataacattttgaaatgatgcaaataaatttccaaacaaaaatagtgtgaatttaaaagcaaattatttgagtatctaagaaacaagatagacttctagaaaaatttgactctctagaatatttcttgcagaaatgagatttttcataatagtaaaagaggcatatgtttatcaaacaatgctgtcacaaaaagcatcaactgtaatgggactattaatgcataattattgatttattcattcaattaatatacaattatcccttttcatttaaagatttaattcataattacaattataataaaacttcctttaaagtaagatacaataattttattgtttttcattcttttttcaacaaaatatcccatccaatcattttttatattattaaatattggctgctttttcttggattcacattaaacagccctttccaacttccaattgtcttaaaataatgatgacctcctgtgagtagatacagctctttacaatttttttctttagtgccttttcttcttgaatttttcctatatcaaatggagaatatatgtacagatggtattttctcagtttataggcatatcagtgaccatggctttctttatataggtttttaaaaaagccctaaataataaatagccagatgagctggggacattgagaaatagtcttcctcttcctttttcaactcatttttttcccacctacatgactgtaaatcaaatatttaatagctcttacttaaaaaaacagatacaaagaatgtcttgatttggtgtgctcatttaccataatgtcatgaggggaattagatttcacaactttaaaaggaatatatttttattttattttgaaaaactgagtcatataggaattttcttatacttcaaggcatcatggaaacanttttttcctgtttggntattgtggaatttaaacgttcaaataaataaatggcataactaagtgttccaaatttttttacaatgtctttgaccctattcaaacactttaggtatttactgaccgtctgatgtgtaagatgtggaataaaactggaatcaattaattatttcactgtgttatcagcgcaagatcaaccatctgggtttcttaaagacacccgaaggattgaattttgtttcagtattgataatggcatagtctctatgtgctacatggaattacatcatttatccctccagtgccctatatgttgataagtatgtcagtttgacttagtatacatatatacagagatttcattacatttacctaataaatacaaaatacatttcgagtgttactgatctcctatgttacatgagcctcctgtaatcattgtgcattgatgttccaatgttttattgtttgtatgaattttaatttgaaaacaaggaaacaatccaaaagcagaaaaaatagcttttcttaaaattttcagtgctacattttccctctgaggtccatagagatttgaatgtataggagattatccgaaaacagctattttgattaaaaaatatatctcccaggattcaaccaacttaatgatgaagtactattgtctactgctttatacatatcagatgacttctattgtgttttctactgatgaaattctctgtaaaatgtctttttcttacattatccaacaggcataaagaataacagtaaagacttttgtgtttgtaatactacctcttttatccctgcactactgttttattgcaaaaattctatattg

SEQ ID NO: 435515 - DNA, 2336 bp, Homo sapiens
  misc_feature (40)..(40): n is a, c, g, or t
  misc_feature (63)..(63): n is a, c, g, or t
  misc_feature (73)..(73): n is a, c, g, or t
tcgacactattggatcaaagaattcggcacagcacttggngccgagcggatataaaaacactntccgcacgtncgccggcgcctcaggtttcccccggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgccaaatgcaaaaaa

SEQ ID NO: 435516 - DNA, 1049 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggaggtaggctcacccttgcccaggcttttcttctcggactgctcagatcctagcaggcctcagcctcggtatgattcagggtcagctatagctactggaatgtcctaacagaccccatttactgagggccttgctaaaccctgaaactatgtgaatcttcttgagttcttatgatactgctgtgtgggaagtcctgctgtccaaaggcagagatgaggaaccagacctcagagagaagtgattttcccagagtcacagagaagttagcagagctggagttaagattcattctagaggcagtactcttag

SEQ ID NO: 435517 - DNA, 3818 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435518 - DNA, 3781 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435519 - DNA, 3664 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435520 - DNA, 3883 bp, Homo sapiens
cgccccttctcctaggagacagttgtccggccccgccccagcatccccgcggctccctgcgcggttctggccctctggggcccacttggggccgagcggttctcacccgccctctccgcacgtccgccggcgcctcaggtttcccccggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435521 - DNA, 3826 bp, Homo sapiens
cgccccttctcctaggagacagttgtccggccccgccccagcatccccgcggctccctgcgcggttctggccctctggggcccacttggggccgagcggttctcacccgccctctccgcacgtccgccggcgcctcaggtttcccccggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435522 - DNA, 3585 bp, Homo sapiens
cgcggggcctctcctcctcccgctaacgggcggtcggccgcctccttcctctcttggctaccacggggctctgcccctcctctgccgcccgcgggcaggcttcacctttctctctatgggcagaaaccggtaccctcctgcctgctggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435523 - DNA, 3647 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435524 - DNA, 3655 bp, Homo sapiens
cgccccttctcctaggagacagttgtccggccccgccccagcatccccgcggctccctgcgcggttctggccctctggggcccacttggggccgagcggttctcacccgccctctccgcacgtccgccggcgcctcaggtttcccccggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435525 - DNA, 3274 bp, Homo sapiens
attgtagcccaagcttttaattttgatgttgggaattctccaaaaccatcatttaaacatggataggtaatgttccatcacaagggttcagagtatgttcttcctggggtccccgagttagctgttacagcttttcccgtctaatcagtaaataagcctccagtggtggaactcgtggtcaaggttctgccttctgagttcatgtgtttctccctcctctacatcagaatccacctcattgcctggagatcacgccaccatcttcagaaaagctggtctcagtgatgcggttaagtgacctctctacagaagatgatgactcaggtcaacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435526 - DNA, 2896 bp, Homo sapiens
cttgaagatgacctctggtcaccagggcctctgaggagagctcatcatgggtctcctgggatcacagtgagtcaaggcatgagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435527 - DNA, 2492 bp, Homo sapiens
gtgtttcctaactgctctatgaaaagaaaggttaaactctgtgagttgaaggcacacatcacaaaggagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435528 - DNA, 3340 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggttagaggcacttggtcccatctctgtcctcttcctaggacctgagactttcagccacttagctgttttttgcttagtgtgcggaagtgttgagggactcgaggccctggaaggtactaggcagacctcagaggaaaagctgcttccatttcagtggaaactggaggcgaccagtgcccagaatatcgagttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435529 - DNA, 2182 bp, Homo sapiens
taaccttacattgcctgccttctccgttgaacctgagcattctcagggactttgagccttgatagctgaggcttctgcataaaacagccctctgggtaaattctcaaacttgccaactcaaaaggattgacagatttcctgttgtcttgcctgcacttgtccccagttaagaggaggttgagatcaatagtaccagcaacataacaggtaaagctctgtggttggtttgtatgggccagttagccctgccagctgtttctgccttctcatgtctgtcctggatcctagctgggtctctctgagtggcctcccctgatcgagaaagcatctttgtcattctttagcatcaaacctggtttctcccagtgtggggagagccttttgtctttggagttgggcctaacctgtccctgctgtcctttctcctctaggttgtgcgttgagacttggacacctgctgagggcactgtgcccctttcctgggtgtggacaacaggtcatagggaaaggggagggctctagcgggaaattcctttgtaaaccagtctgtgttcctgtcattttagatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435530 - DNA, 2338 bp, Homo sapiens
taaccttacattgcctgccttctccgttgaacctgagcattctcagggactttgagccttgatagctgaggcttctgcataaaacagccctctgggtaaattctcaaacttgccaactcaaaaggattgacagatttcctgttgtcttgcctgcacttgtccccagttaagaggaggttgagatcaatagtaccagcaacataacaggtaaagctctgtggttggtttgtatgggccagttagccctgccagctgtttctgccttctcatgtctgtcctggatcctagctgggtctctctgagtggcctcccctgatcgagaaagcatctttgtcattctttagcatcaaacctggtttctcccagtgtggggagagccttttgtctttggagttgggcctaacctgtccctgctgtcctttctcctctaggttgtgcgttgagacttggacacctgctgagggcactgtgcccctttcctgggtgtggacaacaggtcatagggaaaggggagggctctagcgggaaattcctttgtaaaccagtctgtgttcctgtcattttagatcgaacaccagggggacaagctggagatggcgagagagaaacatcaggcttcccagaaggaaaataaacagctgagtctgaaggtggatgaactggagaggttagaggcacttggtcccatctctgtcctcttcctaggacctgagactttcagccacttagctgttttttgcttagtgtgcggaagtgttgagggactcgaggccctggaaggtactaggcagacctcagaggaaaagctgcttccatttcagtggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435531 - DNA, 2406 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggaatgttacctgcaaataacaaaacaacaacaaaaaacacacaccttcgacgagcccctcttatctgtctcgggggttggcgccaaaacaaggccgcgtcctctagacactggggcccaattgggctcatttacctgcgtctccctggaccccacgctctcctttgtcacccacgggtggctaaactcccttgccgcggctcttccccatttttgtgacctccgacttacattttcccgatacaacgccccaggttcttactcgtgcattcatgccacttccggcgacgacctcccgccgcgcgccatgcgccctcctcggcgcgcgcgccctctcctcgcctctccggacagcgaccgaccccgccgccctcgttcaccttcctcgcactcggcgctcccgcgtccccgccaccctcccccgctgcccgcctcccccccctcgcctctctgccccgcctcccccccactctccgtcccccctcccccccccc

SEQ ID NO: 435532 - DNA, 1231 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaacagactaactggaggcaaaaggacactgtgaaaccgctggctgtggcgacctccgaaaacggcgccggctgttactgtggcgacaggc

SEQ ID NO: 435533 - DNA, 400 bp, Homo sapiens
tccagcagctgaaggcctcagtgaagaactatgaggggatgattgacaactataagagtcaggtaggcctcactggggccctggcccttctgagcagtgccctccctgcccccatcagactgggggctccctaccaggccactcccagggagggttgggtatggaagatggttttcatcaaaacgtggctctacctaagatgaaccacagtgttgttggtccctaggtgatgaagaccagattggaggctgatgaagtagctgcccagctagaacgctgtgacaaagagaacaagatccttaaagatgagatgaacaaagagattgaggcggtactgctttccttccttgttttcttctcctacccaattccatatctaactcaatgactgtgagtctgt

SEQ ID NO: 435534 - DNA, 4106 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgttgagatcactgtgtagaaggatccgcctgctttccgctgtgcttcactaaatccaaggaggagctgtgcattccagcaggtttagaggagatccagccctaaggaccctggggccggcgtctgggatctgttctggaacggaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435535 - DNA, 755 bp, Homo sapiens
  misc_feature (17)..(17): n is a, c, g, or t
  misc_feature (39)..(39): n is a, c, g, or t
  misc_feature (80)..(80): n is a, c, g, or t
  misc_feature (101)..(101): n is a, c, g, or t
  misc_feature (103)..(103): n is a, c, g, or t
  misc_feature (117)..(117): n is a, c, g, or t
  misc_feature (132)..(132): n is a, c, g, or t
  misc_feature (152)..(152): n is a, c, g, or t
  misc_feature (157)..(157): n is a, c, g, or t
  misc_feature (184)..(184): n is a, c, g, or t
  misc_feature (215)..(215): n is a, c, g, or t
  misc_feature (221)..(222): n is a, c, g, or t
  misc_feature (229)..(229): n is a, c, g, or t
  misc_feature (236)..(236): n is a, c, g, or t
  misc_feature (253)..(253): n is a, c, g, or t
  misc_feature (265)..(265): n is a, c, g, or t
  misc_feature (276)..(276): n is a, c, g, or t
  misc_feature (294)..(294): n is a, c, g, or t
agcgccattgtttaganttttgggcccaataaaaggccnttttccccaggttaaaatttggttaacgccaggtcaaggtnctttttgacaccaaccagttntnggaaactttaaagnttgccagtgaacttnttttttaaatttaaaccccncccgnttaccagggcccaaggtttttggtttnccaaatgggagggccaaaatttcaattccangggcannccctttngaaggtnccaacccaagcttgaanggccttcaagtngaaagaaactnatgaaggggatgatttgncaaactattaagagttcaaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgccaaatgcaaaaaa

SEQ ID NO: 435536 - DNA, 245 bp, Homo sapiens
ccttcaacatctcatttccaacatctcatcaccccttccaacatctcatggcggaaaaaggtcttgagagcaccttgtggcgcacccagtgtaactgtgacgaagccaaccatgaaggaccgctcttcaactccccccttacatgttcacgtggatgagaacacccctgtccacgtccacataaaaaaactcccgaaaccatcagcgaccagcagccagaaatctcacaagcgatgagatgttgg

SEQ ID NO: 435537 - DNA, 4128 bp, Homo sapiens
  misc_feature (40)..(40): n is a, c, g, or t
  misc_feature (63)..(63): n is a, c, g, or t
  misc_feature (73)..(73): n is a, c, g, or t
tcgacactattggatcaaagaattcggcacagcacttggngccgagcggatataaaaacactntccgcacgtncgccggcgcctcaggtttcccccggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgttgagatcactgtgtagaaggatccgcctgctttccgctgtgcttcactaaatccaaggaggagctgtgcattccagcaggtttagaggagatccagccctaaggaccctggggccggcgtctgggatctgttctggaacggatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435538 - DNA, 3761 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435539 - DNA, 3607 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435540 - DNA, 3825 bp, Homo sapiens
cgcggggcctctcctcctcccgctaacgggcggtcggccgcctccttcctctcttggctaccacggggctctgcccctcctctgccgcccgcgggcaggcttcacctttctctctatgggcagaaaccggtaccctcctgcctgctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435541 - DNA, 3590 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435542 - DNA, 3104 bp, Homo sapiens
gcagctcttcctgccctcctaagtcccagaacatgagccgagcctttcccacatccacagtgccgatgtgtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435543 - DNA, 3974 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggttagaggcacttggtcccatctctgtcctcttcctaggacctgagactttcagccacttagctgttttttgcttagtgtgcggaagtgttgagggactcgaggccctggaaggtactaggcagacctcagaggaaaagctgcttccatttcagtggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435544 - DNA, 2225 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgccaaatgcaaaaaa

SEQ ID NO: 435545 - DNA, 3197 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggatttccacagtccttacgctcatgttaggattctcccagttttctgctaacagggagtctctgggtgagcccactgttttttcgtcaagcgtc

SEQ ID NO: 435546 - DNA, 1798 bp, Homo sapiens
gctgcaagttgctgtgttccatgtgatgctatccacacttaacaaagcccacggtcagtctctgcgttcccacccttcactctgttctctaaccagttgctccagctgcacagttctttggtcgccttgctgatctgcagatttctttggcttattcctgtggctccttggagattcttggcatgatgagatccccagtccaggagaggctggcagccccctggcggggtggaacatgacaggttggggtatgcccaggatctgattgagtgctttcacctaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggtttttttctgacctaaaccagcaggaagtcgtcctgggctgtaagcaccatcacttgcttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagttatttaaggctccatttgatgatttcctttacccaaccagtcctcatccctcctctaaaaaatgattaagtaaaatgctgcaggacagccagtagacatttttaaagtacttggtgcctgaaacatcaggcttctcatttcattttagctcaggttggtgctttcacattgtaatcaatgaactgtcaggagggaacaaactgtaagaaggactgcttggtgttttagggtagatcactttagctattaggaagaggatggggtagtgtacagtatatatttttaaaatgtgaattggtttctgaataagaatttgggccatttttgttcccca

SEQ ID NO: 435547 - DNA, 2079 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgccaaatgcaaaaaa

SEQ ID NO: 435548 - DNA, 846 bp, Homo sapiens
ggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggaggtaggctcacccttgcccaggcttttcttctcggactgctcagatcctagcaggcctcagcctcggtatgattcagggtcagctatagctactggaatgtcctaacagaccccatttactgagggccttgctaaaccctgaaactatgtgaatcttcttgagttcttatgatactgctgtgtgggaagtcctgctgtccaaaggcagagatgaggaaccagacctcagagagaagtgattttcccagagtcacagagaagttagcagagctggagttaagattcattctagaggcagtactcttag

SEQ ID NO: 435549 - DNA, 1921 bp, Homo sapiens
agttcttatcacctacaatgggtagaatgtgaacttgttacctttggcaagttttcatttttccttggtggattccttctgtgactccaggtatcttgataatgggagactggtttatttgttctttaattgcccagatttctttcaactggtaaaacatcatacttcttcagcaaaaggaattcttctagcagagccttcatggatgatatctgtcacacatgccagcacctgcagtttggaaggcagtggtgaatggatccatgcaatatgtctagaagacacaaggatgagccagccacctgatcttgtcatttataaacttttaagaattactctggtttacttttggtctgaaaatggaaaggcccaaataatgaaataatcttttcagattggaattttacatggccatgaaaatatttctttctattcagaagactgaaatagaggaagcttgagagactcctttcttttaaaagcggctctctgtatctgtttcatttaaaacatttgtgggattgaaaatcaccttaatgaagtaggcaaacatttttttaagtagtagaggaagtccagaaaacttaatgaaatggttttttttgttgcctgacactgaaagtaactagtaaataaagggtgaacttcttaattattcgaaaactgcttttaatattaggatatactcttttagctcatcttcgctggtcttgaggcttattataattgtcaaatcaacaaagtttctaatagagaagtagaagaaatatcttttgagatgtaagtagcttggtctgtcttctaaagtaatacatacctgttaaacttgaggtatttttttcatactgaaggcattctaaagtttggtactgtcacaaaacagtagtttacagagcagaagcacttagtattagaataagcctgtaggtgtgaaggaataagtgttgcaaaatagttatttatccaagctgtcaattaattgattgaagtagttatcaaaatgtttctgtttctttctttggtatctattaactggtcagtcaaaagctattaaagaatgtttttaaagtcacctaatgctgccagtttgttaaatttggtatacattttaagaatagacattctagagttattaatatggaagcagctaaaatgttttaggaaatctcaaaagttttagaagccacatttgctaaagcataacctgcacttagtctttcttggctatctgtatttttttctcattaattataaataaatttttgttaagtatagtatttaaaagtaagtttaaaggttcaatttgaactgaaatttccccagagagctttgaattcccataagtgattacagcttttactcccgacttgtttttagtaaatgttaataagacaattggtttacaaacacatataaattaaaaaaaacaactgtccatcgttttaggaagaactgaaggaactaaaaatgatatttgcttggaaattaagttagttgaactctttgaaccacagtagaaaccgctttgtgtggcctgtgagattataagctttttgtttcagctttgaagatgaaaagtgatttaatctcttaatctcatgctttgattgaattttagctctgttccttaaaatatgcaaaaggaaatgtaagtgcatttctagtcacctcatgccactacaagctatttatttaaaagtgaaactttttgtatattattgtgaactgatttgtttatttaaacttttattttggtgaatttacctttgagtttttttatattttatgtcacaaaatgaagtcctatatttttcagtgtttatgaatattaatataaactatttttttctagaatgactaattgtgtaatatctgtattatgtgataatttgaaatctaataaatattttctccatgaaaa

SEQ ID NO: 435550 - DNA, 3370 bp, Homo sapiens
  misc_feature (1)..(1): n is a, c, g, or t
nctgctgtgggtagttttaatcctaatgtgacaagcagcatgcttggtaatgttaatataagtacaagcaatattcctagtgctgctggtgtgagtgttgggcctggagttaccagtggtgttaatgtgaatatcttgagtggcatgggcaatggtactatttcttcctctgctgctgttagcagtgttcctaatgcagctgcagggatgactgggggatcggtttcaagtcagcagcaacaaccaacagttaacacttcgaggttcagagttgtgaagttagattctagttctgagccctttaaaaaaggtagatggacttgcactgagttctatgaaaaagaaaatgctgtacctgctacagaaggtgtgctgataaataaagtggtggagactgtaaagcaaaatccgatagaagtgacttctgaaagggagagcactagtgggagttcagtgagcagtagtgtcagcacactgagtcactatacagagagtgtgggaagtggagagatgggagcccctactgtggtggtgcagcagcagcagcagcaacaacaacaacaacagcaacaaccagctctccaaggtgtgaccctccaacagatggattttggtagcactggtccacagagtattccagcagttagtataccacagagtatttctcagtcacagatctcacaagtacaattacagtctcaagaactgagctatcagcaaaagcaaggtcttcagccagtacctctgcaagccactatgagtgctgcaactggtatccagccatcgcctgtaaatgtggttggtgtaacttcagctttaggtcagcagccttccatttccagtttggctcaaccccagctaccatattctcaggcggctcctccagtgcaaactccccttccaggggcaccaccaccccaacagttacagtatggacaacagcaaccaatggtttctacacagatggccccaggccatgtcaaatcagtgactcaaaatcctgcttcagagtatgtacaacagcagccaattcttcaaacagcaatgtcctccggacagcccagttctgcaggagtaggagcaggaacaacagtgattcctgtggctcagccacagggtatccagctgccagtgcagcccacagcagtcccagcacaacctgcaggggcatctgtccagcctgttggccaggctccggcagcagtgtctgctgtacctactggcagtcagattgcaaatattggtcagcaagcaaacatacctactgcagtgcagcagccctctacccaggttccaccttcagttattcagcagggtgctcctccatcttcgcaagtggttccacctgctcaaactgggattattcatcagggagttcaaactagtgctccaagccttcctcaacaattggttattgcatcccaaagttccttgttaactgtgcctccccagccacaaggagtagaaccagtagctcaaggaattgtttcacagcagttgcctgcagttagttctttgccctctgctagtagtatttctgttacaagtcaggttagttcaactggtccttctggaatgccttctgccccaacaaacttggttccaccacaaaatatagcacaaacccctgctacccaaaatggtaatttggttcaaagtgttagtcaacctcccttgatagcaactaatacaaatttgcctttggcacaacagataccactaagttctacccagttctccgcacaatcattagctcaggcaattggaagccaaattgaagatgccaggcgtgcagcggagccctccttagttggcttacctcagactatcagtggtgacagtgggggaatgtcagcagtttcagatgggagtagcagcagcctagcagcctctgcttctcttttcccgttgaaggtgctaccgctgacgacacccctggtggatggcgaggatgagagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435551 - DNA, 3912 bp, Homo sapiens
  misc_feature (1)..(1): n is a, c, g, or t
nctgctgtgggtagttttaatcctaatgtgacaagcagcatgcttggtaatgttaatataagtacaagcaatattcctagtgctgctggtgtgagtgttgggcctggagttaccagtggtgttaatgtgaatatcttgagtggcatgggcaatggtactatttcttcctctgctgctgttagcagtgttcctaatgcagctgcagggatgactgggggatcggtttcaagtcagcagcaacaaccaacagttaacacttcgaggttcagagttgtgaagttagattctagttctgagccctttaaaaaaggtagatggacttgcactgagttctatgaaaaagaaaatgctgtacctgctacagaaggtgtgctgataaataaagtggtggagactgtaaagcaaaatccgatagaagtgacttctgaaagggagagcactagtgggagttcagtgagcagtagtgtcagcacactgagtcactatacagagagtgtgggaagtggagagatgggagcccctactgtggtggtgcagcagcagcagcagcaacaacaacaacaacagcaacaaccagctctccaaggtgtgaccctccaacagatggattttggtagcactggtccacagagtattccagcagttagtataccacagagtatttctcagtcacagatctcacaagtacaattacagtctcaagaactgagctatcagcaaaagcaaggtcttcagccagtacctctgcaagccactatgagtgctgcaactggtatccagccatcgcctgtaaatgtggttggtgtaacttcagctttaggtcagcagccttccatttccagtttggctcaaccccagctaccatattctcaggcggctcctccagtgcaaactccccttccaggggcaccaccaccccaacagttacagtatggacaacagcaaccaatggtttctacacagatggccccaggccatgtcaaatcagtgactcaaaatcctgcttcagagtatgtacaacagcagccaattcttcaaacagcaatgtcctccggacagcccagttctgcaggagtaggagcaggaacaacagtgattcctgtggctcagccacagggtatccagctgccagtgcagcccacagcagtcccagcacaacctgcaggggcatctgtccagcctgttggccaggctccggcagcagtgtctgctgtacctactggcagtcagattgcaaatattggtcagcaagcaaacatacctactgcagtgcagcagccctctacccaggttccaccttcagttattcagcagggtgctcctccatcttcgcaagtggttccacctgctcaaactgggattattcatcagggagttcaaactagtgctccaagccttcctcaacaattggttattgcatcccaaagttccttgttaactgtgcctccccagccacaaggagtagaaccagtagctcaaggaattgtttcacagcagttgcctgcagttagttctttgccctctgctagtagtatttctgttacaagtcaggttagttcaactggtccttctggaatgccttctgccccaacaaacttggttccaccacaaaatatagcacaaacccctgctacccaaaatggtaatttggttcaaagtgttagtcaacctcccttgatagcaactaatacaaatttgcctttggcacaacagataccactaagttctacccagttctccgcacaatcattagctcaggcaattggaagccaaattgaagatgccaggcgtgcagcggagccctccttagttggcttacctcagactatcagtggtgacagtgggggaatgtcagcagtttcagatgggagtagcagcagcctagcagcctctgcttctcttttcccgttgaaggtgctaccgctgacgacacccctggtggatggcgaggatgagagctctctatttcagtgcttctctcctaccagaggtgcaaggagtgatcctagaaccacagatacagccaagaccacggagagcttttgacgtcaggggtccactttctccactgaacccttggagacagaatatccagcttctggagagagtgggaaaggataataaacaaatttctttcaactggtaaaacatcatacttcttcagcaaaaggaattcttctagcagagccttcatggatgatatctgtcacacatgccagcacctgcagtttggaaggcagtggtgaatggatccatgcaatatgtctagaagacacaaggatgagccagccacctgatcttgtcatttataaacttttaagaattactctggtttacttttggtctgaaaatggaaaggcccaaataatgaaataatcttttcagattggaattttacatggccatgaaaatatttctttctattcagaagactgaaatagaggaagcttgagagactcctttcttttaaaagcggctctctgtatctgtttcatttaaaacatttgtgggattgaaaatcaccttaatgaagtaggcaaacatttttttaagtagtagaggaagtccagaaaacttaatgaaatggttttttttgttgcctgacactgaaagtaactagtaaataaagggtgaacttcttaattattcgaaaactgcttttaatattaggatatactcttttagctcatcttcgctggtcttgaggcttattataattgtcaaatcaacaaagtttctaatagagaagtagaagaaatatcttttgagatgtaagtagcttggtctgtcttctaaagtaatacatacctgttaaacttgaggtatttttttcatactgaaggcattctaaagtttggtactgtcacaaaacagtagtttacagagcagaagcacttagtattagaataagcctgtaggtgtgaaggaataagtgttgcaaaatagttatttatccaagctgtcaattaattgattgaagtagttatcaaaatgtttctgtttctttctttggtatctattaactggtcagtcaaaagctattaaagaatgtttttaaagtcacctaatgctgccagtttgttaaatttggtatacattttaagaatagacattctagagttattaatatggaagcagctaaaatgttttaggaaatctcaaaagttttagaagccacatttgctaaagcataacctgcacttagtctttcttggctatctgtatttttttctcattaattataaataaatttttgttaagtatagtatttaaaagtaagtttaaaggttcaatttgaactgaaatttccccagagagctttgaattcccataagtgattacagcttttactcccgacttgtttttagtaaatgttaataagacaattggtttacaaacacatataaattaaaaaaaacaactgtccatcgttttaggaagaactgaaggaactaaaaatgatatttgcttggaaattaagttagttgaactctttgaaccacagtagaaaccgctttgtgtggcctgtgagattataagctttttgtttcagctttgaagatgaaaagtgatttaatctcttaatctcatgctttgattgaattttagctctgttccttaaaatatgcaaaaggaaatgtaagtgcatttctagtcacctcatgccactacaagctatttatttaaaagtgaaactttttgtatattattgtgaactgatttgtttatttaaacttttattttggtgaatttacctttgagtttttttatattttatgtcacaaaatgaagtcctatatttttcagtgtttatgaatattaatataaactatttttttctagaatgactaattgtgtaatatctgtattatgtgataatttgaaatctaataaatattttctccatgaaaa

SEQ ID NO: 435552 - DNA, 2137 bp, Homo sapiens
tttgatttggtcttccactcagagttgagtggtttatcacagagtgtgttatggcttagaccaatacaggtcccttcttaatagtggtagctcctttttatcctgaggattaagccattacaaactcaaatgaccagagaatgtaatttcttaataagaatttttccttaaatctatattcagctctctatttcagtgcttctctcctaccagaggtgcaaggagtgatcctagaaccacagatacagccaagaccacggagagcttttgacgtcaggggtccactttctccactgaacccttggagacagaatatccagcttctggagagagtgggaaaggataataaacaaatttctttcaactggtaaaacatcatacttcttcagcaaaaggaattcttctagcagagccttcatggatgatatctgtcacacatgccagcacctgcagtttggaaggcagtggtgaatggatccatgcaatatgtctagaagacacaaggatgagccagccacctgatcttgtcatttataaacttttaagaattactctggtttacttttggtctgaaaatggaaaggcccaaataatgaaataatcttttcagattggaattttacatggccatgaaaatatttctttctattcagaagactgaaatagaggaagcttgagagactcctttcttttaaaagcggctctctgtatctgtttcatttaaaacatttgtgggattgaaaatcaccttaatgaagtaggcaaacatttttttaagtagtagaggaagtccagaaaacttaatgaaatggttttttttgttgcctgacactgaaagtaactagtaaataaagggtgaacttcttaattattcgaaaactgcttttaatattaggatatactcttttagctcatcttcgctggtcttgaggcttattataattgtcaaatcaacaaagtttctaatagagaagtagaagaaatatcttttgagatgtaagtagcttggtctgtcttctaaagtaatacatacctgttaaacttgaggtatttttttcatactgaaggcattctaaagtttggtactgtcacaaaacagtagtttacagagcagaagcacttagtattagaataagcctgtaggtgtgaaggaataagtgttgcaaaatagttatttatccaagctgtcaattaattgattgaagtagttatcaaaatgtttctgtttctttctttggtatctattaactggtcagtcaaaagctattaaagaatgtttttaaagtcacctaatgctgccagtttgttaaatttggtatacattttaagaatagacattctagagttattaatatggaagcagctaaaatgttttaggaaatctcaaaagttttagaagccacatttgctaaagcataacctgcacttagtctttcttggctatctgtatttttttctcattaattataaataaatttttgttaagtatagtatttaaaagtaagtttaaaggttcaatttgaactgaaatttccccagagagctttgaattcccataagtgattacagcttttactcccgacttgtttttagtaaatgttaataagacaattggtttacaaacacatataaattaaaaaaaacaactgtccatcgttttaggaagaactgaaggaactaaaaatgatatttgcttggaaattaagttagttgaactctttgaaccacagtagaaaccgctttgtgtggcctgtgagattataagctttttgtttcagctttgaagatgaaaagtgatttaatctcttaatctcatgctttgattgaattttagctctgttccttaaaatatgcaaaaggaaatgtaagtgcatttctagtcacctcatgccactacaagctatttatttaaaagtgaaactttttgtatattattgtgaactgatttgtttatttaaacttttattttggtgaatttacctttgagtttttttatattttatgtcacaaaatgaagtcctatatttttcagtgtttatgaatattaatataaactatttttttctagaatgactaattgtgtaatatctgtattatgtgataatttgaaatctaataaatattttctccatgaaaa

SEQ ID NO: 435553 - DNA, 927 bp, Homo sapiens
agatagtttctttaaatttattcgtgggatacttataataatacaggtgaaagatagccaggcgaattcctttgtccattgctgagagattatggtgacatggatgttgtttttcgaaatgttaaaaaaccttatttttgcaagtctggccagagaacaggctttccccacattatgtaatttagtcctttgtggcttactaaaatagggagatgcctggatattcgttagtaagagaggggctggcattttctggagggtgatacattacatagtgttaaataacattcaaaatatgatgctagcaatatcacaaaattgggagatcctttttatcttggacgcttaagataaattccatttatcgatgacctttttccctcctctttttcagctcctctggtgcaagtgtggtagctattgacaacaaaatcgagcaagctatggtatgtactgatgaaaaatcatttatactaaatgtgggcacagcacaaaaataagatgttttgtggaaccagtgcatccctaagttcagatgatgatgattgctcttgatgcgcgtagaaatgccggcgctgtctccattcggccagcgtggagccacctaccacggcagccgtggagggagaaaggggccctgcgggtattaaatggtcttcttccccggactggtttcacacgacgggattttctcacggtgaccctttttgctggggatttattagggaagcgctggccaactatctccttcggctggtcgtgagcacacctttagcgatgtggctttactaggaatcctaatattttactagggagccgggaggtggggagggccccagaagtcgggatcctggataagggtcttctagacggtgcacaaacgggtccccggtggcgcgggctccttcacaatgaagaagaatcaga

SEQ ID NO: 435554 - DNA, 322 bp, Homo sapiens
ctggagcatggggagcaaggggacagtggtgtgagatgaagctgcagaggtaagcaggggccagatgctgtagggccctgtaagagttaggttcctattatactgtgaatagagctttgttgaaagatttttaactggaactgggtggtgggcaacatagtctaatgtgcctttaaaaaaatcatcctggctgttggatggagaaacggattatagaggaataagagtggaagctgggaggtgtgttgggacatgatttatgttatccaggtggcagtgttaaactgattcgtttcctttttttaaaaaaacaattcatatt

SEQ ID NO: 435555 - DNA, 1839 bp, Homo sapiens
agcggagtggcgtgccggccaatcggcgcagctctttcctgcatatattttgcactaagactgggagtccgggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435556 - DNA, 2097 bp, Homo sapiens
agcggagtggcgtgccggccaatcggcgcagctctttcctgcatatattttgcactaagactgggagtccgggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaaaaaaaaaattcatatgaccctgttaacataatggcagtcatttccacaactgtttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggacgg

SEQ ID NO: 435557 - DNA, 2124 bp, Homo sapiens
agcggagtggcgtgccggccaatcggcgcagctctttcctgcatatattttgcactaagactgggagtccgggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataagaaaaaaaaaaaaaaaaaaagaaaaaaaagggggggcagggctagagtaaaacaagagaaggggccccaagataacggggtcgcacaaggataacggggacaaaggtggggcccatagagggagacgcgcagaatagaaaagacaagagccacaagcacgcgagaggaaccacaaacgagcgaaagaacggcgagaaaacacgcagaaagagggaaacaacaggagagaaagaaaacacaaaaaaaaggagacagcgccacccaacaggcgcgcacagcaacat

SEQ ID NO: 435558 - DNA, 1492 bp, Homo sapiens
tcgggttacaaataggaagctttcgccgttaagcagccgcgggacacagctccggggaccggggtctgactcccttaaacctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435559 - DNA, 1499 bp, Homo sapiens
agcgggcctgggtgggaagagaggcccaagaaagccaccatagtctgtagcgtgaagcttttcctatagtctagtgataatcctgctctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435560 - DNA, 1722 bp, Homo sapiens
agcagcagcaacccgctcgggtcttcttctccgccgtggaagctttgttgttttactgttagcgataaatcttgctgctgctcactttttgggtctgcactacctttatgagctgagctgtaacactcactgcgagggtccacggctttattctttaagtcagcgagaccaacaacccacgggaaggaaccaattccagatacaattgctcagttattcagttgaattattgagtcatgccctgtaccaaagccgactgacttgagtttggatcttggctctgccatttgttaaacatatgtctccttggctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435561 - DNA, 1461 bp, Homo sapiens
ctggagcatggggagcaaggggacagtggtgtgagatgaagctgcagagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435562 - DNA, 1806 bp, Homo sapiens
agatagtttctttaaatttattcgtgggatacttataataatacaggtgaaagatagccaggcgaattcctttgtccattgctgagagattatggtgacatggatgttgtttttcgaaatgttaaaaaaccttatttttgcaagtctggccagagaacaggctttccccacattatgtaatttagtcctttgtggcttactaaaatagggagatgcctggatattcgttagtaagagaggggctggcattttctggagggtgatacattacatagtgttaaataacattcaaaatatgatgctagcaatatcacaaaattgggagatcctttttatcttggacgcttaagataaattccatttatcgatgacctttttccctcctctttttcagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435563 - DNA, 1487 bp, Homo sapiens
tgacacgggaacagaggtcctcaccatcttttaatccacactgtatcttcctatcaaatcttcctaaatgcagcttgagcaagttttcctctcttcaaaaagttccacagcttccaataccctcacggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435564 - DNA, 1655 bp, Homo sapiens
aactggctgcagccggtgctgaaggaggcggctccgggcgagcgcggggcggggcctgggggcggggacgcggtgggcgcgctgtggcttggacgtccccgctgctggtctcagtcggggacccagcgcccggctctggcccagtctcaggaagccttacttgggcgtttctggccaacgtctgcagagaagcacagacttttacaaagcttgatcatttatacgttaaactcaagtattgtacagtcatgtttgtattcagatttccccaagtgtcattgaaccaactttaaaggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435565 - DNA, 1194 bp, Homo sapiens
ttgaggtacttagaggatcccaggcaaagctctacagccaaggcacacacagccccgccatgcagatctgaggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435566 - DNA, 2046 bp, Homo sapiens
  misc_feature (1438)..(1439): n is a, c, g, or t
  misc_feature (1475)..(1475): n is a, c, g, or t
agcggagtggcgtgccggccaatcggcgcagctctttcctgcatatattttgcactaagactgggagtccgggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatgnngtttttgtcatgtagcagtttttatgtagatctatntataaaagtccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaaaaaaaaaattcatatgaccctgttaacataatggcagtcatttccacaactgtttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggacgg

SEQ ID NO: 435567 - DNA, 1933 bp, Homo sapiens
agcggagtggcgtgccggccaatcggcgcagctctttcctgcatatattttgcactaagactgggagtccgggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatcaaaattcataaaagaacaatagtactgtgcctctttcttctcaaacaatggatgacacaaaattatgagagtgacaaaatggtgacaggtagctgggacctaggtattttaccatgaaggttgttggcttaatgaatattcggtatggtcgtgtacctattttgtccaattagcagggccggtactacctatttcgcgtgggtcccgaattggacacttcgttggtttccctggtcggtctgaacgggaggcttgggctcttattatataggatgcttaagacggcttgcgtgacgaaaacgcccgctttagaaatttaattgtgcgcgctatccctggtgtgtctcaaactagggcgaaaaccagcaacccctgtttccgagctctacgacgcggcggatcgtcgagaggacgccaaaagagtccaccgaggtgtacacacgaaataatctgccgtcccagagcggctgtgtgggtcccttgtgccagacacacg

SEQ ID NO: 435568 - DNA, 1576 bp, Homo sapiens
  misc_feature (1438)..(1439): n is a, c, g, or t
  misc_feature (1475)..(1475): n is a, c, g, or t
agcggagtggcgtgccggccaatcggcgcagctctttcctgcatatattttgcactaagactgggagtccgggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatgnngtttttgtcatgtagcagtttttatgtagatctatntataaaagtccacacctcctcagacagccaatgaaacaactaaatttcaatctgtacaacctaaatagtagttacagtccactgtcgacgcgcgtcacgcg

SEQ ID NO: 435569 - DNA, 1016 bp, Homo sapiens
ctgaccggacacgttgggggctcctggtgtggctcatcgcgtggcgcttgggggtcgtcgtggggctcgttgcgtggcctttgtgaggctctttaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435570 - DNA, 983 bp, Homo sapiens
ccacctcagcctccagagtagctgagaccacaggtgcatgccaccttgcccagctaattttaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435571 - DNA, 1188 bp, Homo sapiens
gctggacaaggacgggcgcggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgccttgtccagatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435572 - DNA, 703 bp, Homo sapiens
  misc_feature (10)..(10): n is a, c, g, or t
  misc_feature (20)..(20): n is a, c, g, or t
atctagaggntcccaggatncgtagacccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435573 - DNA, 734 bp, Homo sapiens
  misc_feature (52)..(52): n is a, c, g, or t
  misc_feature (63)..(63): n is a, c, g, or t
ggtccccctgccagggacaaatggcgagactaccacccaagggttggatggnctgtctgagcnctgtgcccagtacaagaaggacaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435574 - DNA, 560 bp, Homo sapiens
gaggatccccgttcagacgctgaacaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgata

SEQ ID NO: 435575 - DNA, 721 bp, Homo sapiens
agcggagtggcgtgccggccaatcggcgcagctctttcctgcatatattttgcactaagactgggagtccgggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagccagagccaccttctcctgatcagcaagcaccaccaataca

SEQ ID NO: 435576 - DNA, 960 bp, Homo sapiens
agcggagtggcgtgccggccaatcggcgcagctctttcctgcatatattttgcactaagactgggagtccgggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggtatgtactgatgaaaaatcatttatactaaatgtgggcacagcacaaaaataagatgttttgtggaaccagtgcatccctaagttcagatgatgatgattgctcttgatgcgcgtagaaatgccggcgctgtctccattcggccagcgtggagccacctaccacggcagccgtggagggagaaaggggccctgcgggtattaaatggtcttcttccccggactggtttcacacgacgggattttctcacggtgaccctttttgctggggatttattagggaagcgctggccaactatctccttcggctggtcgtgagcacacctttagcgatgtggctttactaggaatcctaatattttactagggagccgggaggtggggagggccccagaagtcgggatcctggataagggtcttctagacggtgcacaaacgggtccccggtggcgcgggctccttcacaatgaagaagaatcaga

SEQ ID NO: 435577 - DNA, 2667 bp, Homo sapiens
  misc_feature (1)..(1): n is a, c, g, or t
nctgctgtgggtagttttaatcctaatgtgacaagcagcatgcttggtaatgttaatataagtacaagcaatattcctagtgctgctggtgtgagtgttgggcctggagttaccagtggtgttaatgtgaatatcttgagtggcatgggcaatggtactatttcttcctctgctgctgttagcagtgttcctaatgcagctgcagggatgactgggggatcggtttcaagtcagcagcaacaaccaacagttaacacttcgaggttcagagttgtgaagttagattctagttctgagccctttaaaaaaggtagatggacttgcactgagttctatgaaaaagaaaatgctgtacctgctacagaaggtgtgctgataaataaagtggtggagactgtaaagcaaaatccgatagaagtgacttctgaaagggagagcactagtgggagttcagtgagcagtagtgtcagcacactgagtcactatacagagagtgtgggaagtggagagatgggagcccctactgtggtggtgcagcagcagcagcagcaacaacaacaacaacagcaacaaccagctctccaaggtgtgaccctccaacagatggattttggtagcactggtccacagagtattccagcagttagtataccacagagtatttctcagtcacagatctcacaagtacaattacagtctcaagaactgagctatcagcaaaagcaaggtcttcagccagtacctctgcaagccactatgagtgctgcaactggtatccagccatcgcctgtaaatgtggttggtgtaacttcagctttaggtcagcagccttccatttccagtttggctcaaccccagctaccatattctcaggcggctcctccagtgcaaactccccttccaggggcaccaccaccccaacagttacagtatggacaacagcaaccaatggtttctacacagatggccccaggccatgtcaaatcagtgactcaaaatcctgcttcagagtatgtacaacagcagccaattcttcaaacagcaatgtcctccggacagcccagttctgcaggagtaggagcaggaacaacagtgattcctgtggctcagccacagggtatccagctgccagtgcagcccacagcagtcccagcacaacctgcaggggcatctgtccagcctgttggccaggctccggcagcagtgtctgctgtacctactggcagtcagattgcaaatattggtcagcaagcaaacatacctactgcagtgcagcagccctctacccaggttccaccttcagttattcagcagggtgctcctccatcttcgcaagtggttccacctgctcaaactgggattattcatcagggagttcaaactagtgctccaagccttcctcaacaattggttattgcatcccaaagttccttgttaactgtgcctccccagccacaaggagtagaaccagtagctcaaggaattgtttcacagcagttgcctgcagttagttctttgccctctgctagtagtatttctgttacaagtcaggttagttcaactggtccttctggaatgccttctgccccaacaaacttggttccaccacaaaatatagcacaaacccctgctacccaaaatggtaatttggttcaaagtgttagtcaacctcccttgatagcaactaatacaaatttgcctttggcacaacagataccactaagttctacccagttctccgcacaatcattagctcaggcaattggaagccaaattgaagatgccaggcgtgcagcggagccctccttagttggcttacctcagactatcagtggtgacagtgggggaatgtcagcagtttcagatgggagtagcagcagcctagcagcctctgcttctcttttcccgttgaaggtgctaccgctgacgacacccctggtggatggcgaggatgagagctctctatttcagtgcttctctcctaccagaggtgcaaggagtgatcctagaaccacagatacagccaagaccacggagagcttttgacgtcaggggtccactttctccactgaacccttggagacagaatatccagcttctggagagagtgggaaaggataataaacaagtgggtgctttccattatttacttgggttaatttatagattggagtgtccttccattgcccatttaattctgtggtaaactccttgggttcatttaagaaccaggtgggactgcaatctgttttgtttttctgagaatgctaactagtactcattcaaaaatgagacctaaaatttaattttctctccagataattaaagcagtggatgatttggggcacatgatttgacgaatgcctatgtagtccacaggaattttaaaacgggaatatctacccattttggcctttgtggtattagtggacttctaagtgctcttttatattcaagtaatttaaaaggttctgtatttcatctttgggcaaactggacatttgaagtctaatttatacagtcacatgtccaagtgttatcctacactgttagtgagaaccttttggtcttcttcctacctcaaatgttaggacttcatattagatcttttaaaagatgcaatgatagtactattatggttttactgtcaattctaggctccattct

SEQ ID NO: 435578 - DNA, 176 bp, Homo sapiens
cagtctcaggaagccttacttgggcgtttctggccaacgtctgcagagaagcacagacttttacaaagcttgatcatttatacgttaaactcaagtattgtacagtcatgtttgtattcagatttccccaagtgtcattgaaccaactttaaaggtggaatatgtaaatagttagg

SEQ ID NO: 435579 - DNA, 2593 bp, Homo sapiens
cccgagccccgcccctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcatagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttctaaaaaa

SEQ ID NO: 435580 - DNA, 2932 bp, Homo sapiens
cccgagccccgcccctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcatagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttaaaaaaaaaaaaaaaaaaaaaaaaaaaaaaaaaaaaaaaaaaaaaaaaaaaaaaaaaggggggggggggcaaaaaaaatacccccgggggggggcccatttatggtcccccgtttttttggtaaaaagggggcccccaaaagggggaggtaaaaaaagaaaggaggggggggggggtaaaaacgggggggggagggagaaaagctgcgcgtgcgacattttgggaagagccacccttttgtgtgcgtgtgactattgcacaccacccaaagaataaaaagcgaaataaacaggggttgagtggtagcacgttatgtcggcggaattgtttgtttttttatgacccgcctcaaatctaacaggacaaactggaagacacaaggagtatgtaacaacatagacagcagcaataaaaaccataaaagaaacaaagctga

SEQ ID NO: 435581 - DNA, 2830 bp, Homo sapiens
cccgagccccgcccctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaaacctaaattcaggtcagatatcagtgaagaactggcaaatgttttttatgaggactctgataatgaatctttctgcggcttttcagaaagtgaggtgcaagatgtattagaccattgtggatttttacagaaaccaaggccagatgtcactaacgaactggccggtatttttcatgccgactctgacgatgaatcattttgcggtttctcagagagtgagatacaagatggaatgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcatagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttctaaaaaa

SEQ ID NO: 435582 - DNA, 2962 bp, Homo sapiens
cccgagccccgcccctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaaacctaaattcaggtcagatatcagtgaagaactggcaaatgttttttatgaggactctgataatgaatctttctgcggcttttcagaaagtgaggtgcaagatgtattagaccattgtggatttttacagaaaccaaggccagatgtcactaacgaactggccggtatttttcatgccgactctgacgatgaatcattttgcggtttctcagagagtgagatacaagatggaatgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcatagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttctaaaaaaaaaaagcaaaaaaatttggggggggggccgaaagatttaaccactggttgggggggccgggggaaagggaggggcgggacggggaggtgggtcccaaaaggggggggggtgaacagggggggggggaagggg

SEQ ID NO: 435583 - DNA, 2518 bp, Homo sapiens
aacttaaagaaattcagatatgtgaagttcttctttactctgagatctttctgcggcacgcggcgagcgtccatgctggtggcgggtgcccagaaagatctcagagtaaagaagaacttaaagaaattcagatatgtgaagttgatttccatggaaacctcgtcatcctctgatgacagttgtgacagctttgcttctgataattttgcaaacacgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcatagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttctaaaaaa

SEQ ID NO: 435584 - DNA, 3495 bp, Homo sapiens
cccgagccccgcccctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcagtaagtaccagttcttgtttatatacagtagtgttttgggcacacctaaggtcgatctgtgttgtatttaaaaatctaatttctttatttgtgtggccttctagacaaacgaaggggacctagaggaaaccccctgacagatctctggatgatcctccttgaatcctgggcagtttggtctctccttgctgtgctcctgtggcactaaactccttttgattggttctttctttccttcccagctagactaagcccctcatgggcaggtaatgaagattgaaaacttttttctgttctccagtgtgagcacattcctcctacatggtagatgtgcaatagatgtttttaaaattggagaatgaaaataaaagaagaaaatcacaatttcttatcaagttgtagcttggtatcatacacaattgcattctgaggaattaaggtggtacaacttagggagatttggtgtgtctgctgtgatagaaaagatttctttttcctggctttccctgaggaaaggaaagatggaaagagggaagccatacagatatccctctgttttgcagtgtagaaactgaatgtgtttctacagggtcaagagacatcagagaaattttttttttttagaacagaagatcatttcttacatcttcattaagtaaaagaataaatagctcatctctcaagttgaaagaaactgggcttggtattattacaaaagcaaaattaaaatggccatataggttttaggctcattttgccatgcattatgcaaaggacaaagaaaaagaaaaaatagagctctctttacttaaaacatccttaaggagaagctatgaattccccaaagtactacttctctttattatggaataaatggattcccttatacgtgctttgtttagcaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcatagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttctaaaaaa

SEQ ID NO: 435585 - DNA, 2804 bp, Homo sapiens
  misc_feature (2734)..(2735): n is a, c, g, or t
cccgagccccgcccctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaaacctaaattcaggtcagatatcagtgaagaactggcaaatgttttttatgaggactctgataatgaatctttctgcggcttttcagaaagtgaggtgcaagatgtattagaccattgtggatttttacagaaaccaaggccagatgtcactaacgaactggccggtatttttcatgccgactctgacgatgaatcattttgcggtttctcagagagtgagatacaagatggaatgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcatagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttnnaaaaaaaaaagagggggcggtaaatactgagggcatatcgtacatttgtaaagggccagggggaaagag

SEQ ID NO: 435586 - DNA, 2992 bp, Homo sapiens
cccgagccccgcccctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaaacctaaattcaggtcagatatcagtgaagaactggcaaatgttttttatgaggactctgataatgaatctttctgcggcttttcagaaagtgaggtgcaagatgtattagaccattgtggatttttacagaaaccaaggccagatgtcactaacgaactggccggtatttttcatgccgactctgacgatgaatcattttgcggtttctcagagagtgagatacaagatggaatgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcaacaaacgaaggggacctagaggaaaccccctgacagatctctggatgatcctccttgaatcctgggcagtttggtctctccttgctgtgctcctgtggcactaaactccttttgattggttctttctttccttcccagctagactaagcccctcatgggcagcaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcatagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttctaaaaaa

SEQ ID NO: 435587 - DNA, 659 bp, Homo sapiens
cccgagccccgcccctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatggtaggtatctgactttgtgttagaattaatttttcctctctaagcgactcattacttaaatctgttccatcacgcaaaagttatttttttctgttacatgaataaaaagttatttttgtttacctgtgaag

SEQ ID NO: 435588 - DNA, 353 bp, Homo sapiens
aactgcagaaacccagactgctggggcgttcgaggccagttctgtggcccctgccttcgaaaccgttatggtgaagaggtcagggatgctctgctggatccggtaggtgcctgccaggggttggtcctgtgggcttgaaggtcagccacaaactgtgatgaggccagaaaaaggcattggtgaaggggtggagccctttctgttatggggtgctcttctttttttttaagatggagtctcattctgtcgccaggctgcagtgcagtggcgcgatctcagctcactgcaacctcctcctcctgggttcaagcgattctcctgcctcagcctcccaagtagctgggactacaggc

SEQ ID NO: 435589 - DNA, 2491 bp, Homo sapiens
tttgggttagggagagtgctttcgtttgttttaaatgggagaaactggagcatgttgccaaggcagagagccagcagagaggggtgaatggaagaaggagcgagaagggggttactgacgaagccttatcctggaggagagaaggatggactccagagcccagctttggggactggccttgaataaaaggagggccactctacctcatcctggagggagcacgaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgctta

SEQ ID NO: 435590 - DNA, 2619 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgctta

SEQ ID NO: 435591 - DNA, 3160 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttaaaaaaaaaaaaaaaaaaaaaaaaaaaattggggggggggcggggccccggagaaaacctccaacaccactcggttggggccgccggggccccacgagcgggtaacggcgtaacagcgtggtcccaacgcggttccccaggagaagcaccggtggtcacgataacatggcggccgtgggatctcccccacaataacaaaagcgcccggggaggaacacgagagccgtttctcgtagaacaacacatctcccacaagtgggagctctctcagagagggggtggccacataacaccagggaggaggctctcacatatccacaccaccggggggacaggcgcctcaaccagagcagcgacgccccccgcaacagcatctccaacaatatctaaacacgccccccgccgccaccccgggggagggacgcctaccaagccaacgaacacgcacaacctacccgccaacccaacgccaaccacacagacaccaaaccaaaccacagcaccaacaccaactcacaccacacgtcactaccagacacagc

SEQ ID NO: 435592 - DNA, 4587 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttattttgcatactccttgaaatgtgactcttcagaggacagggcacctgctgtgtatgtgtggccgtgcgtgtgtactcgtggctgtgtgtgtgtgatgagacactttggaagactccagggagaagtccccaggcctggagctgccgagtgcccaggtcagcgccctggactgcttgcgcacttgctcaccgagatgatgcagttggaggttgctgatctgtgcgattgctgtagcggttgccggggaccttaagagttattttgcttctctggaaggggcctatgcttgctaggcaggcagccagtgtgtctgtttttcttggtttgctgtgggaccttgcttggcgagggggaaaatctctgggtttctggagtgggagggttcgtgcagcagctgttgactggtacatgaagcattcttttatgtttgttgaagctgatgattgacatctcccgtgggtgtgccagttcttgtggagttaagacaggatttttggaagcaaggaagttagtgggtgagcttggggatgtagctcagctatctgctggtctagtggcctctaagctatagggaggggacagagccctgagctacagatgcttgagtgggttattgtgtcggtttgctagtgcagtctggtttttaagctctaaaattgaggtattttattagaagtggatttgggttgaactcttaatttgtataagggatatattttggttggggaaatagaactgagttgctaattcttattgtactcattactccatacaagaatgttatgttgaataataaaattggagaagatttcattttgtgtttccagggagtattctgtgtggggaactgtttccttacgtgaggccggcggcataagtcaaagatgagttttgtccttgcgaatcacacagattgagtctgtgttccccagggtgtgccgttacctgatttttaagtgagccagggcggacagcagcttttctgatttacagagttcttcagatttacaaatggacaatgacatcacagtttttagcactgaagccagtctcatgctagtaacagtgggtgagccgctcgagggactgggttctaatgaatactggtatgaacggggagtctctgcagtcgccagacaaatcatactcagccccttcccccgtagagcaacaagtggttcttttagagttgactggcagcatttcctgtcgggggaggtggggtttgatggagttagaaagctcgcctctgtgtacattctctcctgggctgttactttctgtagacgcacaaaatcagccccaatgtttttaagggcatcttagccaaggaagctggcttttgtgtcgccacttccaggcctgcattaagagagagcccaggcaccagggctaccactggaacctgcctcagcgtcaactgctgctggtctgtagccaggcccagcctttgagacgggtttactgtcaccagtagcctctcagtgccagccctgagctgctcctggctcagctgcccagagcctgcagcctggggaggtactcagcctctgggagacgagggccgtggactgggtggctggtagctcctgcgtttttgagctgtgtcctggctggctgctgccaatgaggtggacaccagtgtggtttggggtgcactggccacttcttgctgggttctgattttcttggaagtgcatctgccttccttatccaatagttttatccctgcattgctcttgtgaagtggctggtttggttctgtatgtagcattttgtacctttcctctggcaaaacactgtcagtttataaacattttttatatttccctcctttaaaaacagcttgtgtatttctgctataaaatgtgtcagcaaaggcagagtgacctaatagggcatgttcttaagcacagggactgtatcatgcaggggccaataaagctcaagaaaacgagtaaagcatca

SEQ ID NO: 435593 - DNA, 2300 bp, Homo sapiens
gaactggtgctcgagtgggcctggagcttccgaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgctta

SEQ ID NO: 435594 - DNA, 2562 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaagttagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgctta

SEQ ID NO: 435595 - DNA, 2686 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacttttttttttttttttttttacaacacaattgattgggccattttatggatttttacctcctaatagtggatacaggttgccgtggttcccagcaggatctcagatgcgagggg

SEQ ID NO: 435596 - DNA, 2588 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagtcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgctta

SEQ ID NO: 435597 - DNA, 2618 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcataactcgtgcagtcaccctggcgttttcttcctgcaactcttctaacaacactcataatgccacactgtttattcctctctgctaaaatgttctcgacagttttaagaccagtcttctggatctgcccattccttgttccgtttccaatgaaatcaataaaaaaactagaagtactccaaaa

SEQ ID NO: 435598 - DNA, 2130 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacactcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgctta

SEQ ID NO: 435599 - DNA, 2326 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagcccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgctta

SEQ ID NO: 435600 - DNA, 2152 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggcca

SEQ ID NO: 435601 - DNA, 3315 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagaggtaactacccagggcccctctgggctggggaaggagagacctgcacttgggctgggacttagttgatgagtttggtacttgattcttggcctgtctgttcctgttatcttgcaggcctcagggtagacagagttgaattagaggagactttgttctgaattctagaaatcaatgtgaatgaaggatctgaatctggaaactactggaaagcccacaggacttagtgcatttgtagcttttgccacataaatacagggtggtggtgaaatacctgtttcctcttaattatgcagcttaattattggccagagaatgatcgttcttagccagatgtgtgtaactatctatctggttttcggctttaaagtcaagtgtgagaaatgacagcagctttggtgtggtcaactcagcgggagcgggcgcaggtgtgttccctgtgttagctgtgtgtgtcatgtctggaagcctccttggtaggggttcatctgtgccagcctgtagggagcttttgtccctgcccagtggccccacctgttgaatgcactatgggtgaggactcagtggggtgacagttttgccctccctgccccctcccaacttgttgtaggagtatccatgggaaccaagcccctcctgactgccatctggcacaagtgcaggcgtttggaggcagtggatgtgtgctgggaagccgctctgtgtgacctgagggtgatttgtcactgggctgtcctccacacccccaggaggaccaggcgtgctgctgccttgacagttcatcttcaggtgtccaggctgacacctcccaaagctggctgagactctgtgatcatgagggggatttctgggtctttcctgagactgcgtcccacctgacagtacataaagaagttttgcacacgtgaggtcccttttgctatttggaagtgattgaaggggctgcctactgtcctgtgaagagcccctctacgtggggacagcaggagaaaaccacagttctgatacttcacgtttatgcttctgaactcgggtttcttagtaagacatttcaactttttaagttgctagaaaataaaaatgatctacttggctgccttcaattttgaggcaattgaaggacgatccctccctcctttgatactaaaaacaatataggaataaaggaaaatagaattaaaaagtcacccatcttttgcctgaacacaaactttttgatttctcaaacttagcatcacatacctcattctagaggcatttatttcccattagaaagagctttataataaaacaaatagaacaaaaccagaaacgggtaggattgttactgtcttgttgggcattttgctctctgcttttgtagtattacttttaaaaccaatactttccacactgtccagaattgcctgaaattgttatgaactgtttgtttatatacgtgacttgatttccccagggcagctccagggcacagagtgtgtggcttgtatgtgttgaactgatccacgtttcccattcccaggcccctatctctctgttcctcttcttttagttgttaaggcaagttgatctgtaccagtgctggccagtagaagtacagcgtgggccacacacagaattttatgttttctgctggatgtggtggctcatgcctgtaatcccaatgctttgggaggcccaggcaggaggatcgcttgaggccaagagtttgagaccagcctgggcaaaatagcaagaccctgtctctacc

SEQ ID NO: 435602 - DNA, 2147 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagaggagtatccatgggaaccaagcccctcctgactgccatctggcacaagtgcaggcgtttggaggcagtggatgtgtgctgggaagccgctctgtgtgacctgagggtgatttgtcactgggctgtcctccacacccccaggaggaccaggcgtgctgctgccttgacagttcatcttcaggtgtccaggctgacacctcccaaagctggctgagactctgtgatcatgagggggatttctgggtctttcctgagactgcgtcccacctgacagtacataaagaagttttgcacacgtgaggtcccttttgctatttggaagtgattgaaggggctgcctactgtcctgtgaagagcccctctacgtggggacagcaggagaaaaccacagttctgatacttcacgtttatgcttctgaactcgggtttcttagtaagacatttcaactttttaagttgctagaaaataaaaatgatctacttggctgccttcaattttgaggcaattgaaggacgatccctccctcctttgatactaaaaacaatataggaataaaggaaaatagaattaaaaagtcacc

SEQ ID NO: 435603 - DNA, 1783 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggagaatttcaggtataagctcggattgtatatgta

SEQ ID NO: 435604 - DNA, 2754 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagaggtaactacccagggcccctctgggctggggaaggagagacctgcacttgggctgggacttagttgatgagtttggtacttgattcttggcctgtctgttcctgttatcttgcaggcctcagggtagacagagttgaattagaggagactttgttctgaattctagaaatcaatgtgaatgaaggatctgaatctggaaactactggaaagcccacaggacttagtgcatttgtagcttttgccacataaatacagggtggtggtgaaatacctgtttcctcttaattatgcagcttaattattggccagagaatgatcgttcttagccagatgtgtgtaactatctatctggttttcggctttaaagtcaagtgtgagaaatgacagcagctttggtgtggtcaactcagcgggagcgggcgcaggtgtgttccctgtgttagctgtgtgtgtcatgtctggaagcctccttggtaggggttcatctgtgccagcctgtagggagcttttgtccctgcccagtggccccacctgttgaatgcactatgggtgaggactcagtggggtgacagttttgccctccctgccccctcccaacttgttgtaggagtatccatgggaaccaagcccctcctgactgccatctggcacaagtgcaggcgtttggaggcagtggatgtgtgctgggaagccgctctgtgtgacctgagggtgatttgtcactgggctgtcctccacacccccaggaggaccaggcgtgctgctgccttgacagttcatcttcaggtgtccaggctgacacctcccaaagctggctgagactctgtgatcatgagggggatttctgggtctttcctgagactgcgtcccacctgacagtacataaagaagttttgcacacgtgaggtcccttttgctatttggaagtgattgaaggggctgcctactgtcctgtgaagagcccctctacgtggggacagcaggagaaaaccacagttctgatacttcacgtttatgcttctgaactcgggtttcttagtaagacatttcaactttttaagttgctagaaaataaaaatgatctacttggctgccttcaattttgaggcaattgaaggacgatccctccctcctttgatactaaaaacaatataggaataaaggaaaatagaattaaaaagtcacc

SEQ ID NO: 435605 - DNA, 1676 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataaggtacgtctgctcactccagaatggccacgctgacctcagtctgcagtgttttggaggcacttgtgtgtgaagcttgctgtgggtgcggctggggtcctttgtggcagctgtcctggaattttgttgctaggggatgggcagatgaagagctttagttctgtctgatgatccaggtgttcacaccagggagtctggcctctggtctgttttgtgccactctattctgctctctgcagccctgctgttgagttaggatgtcccgatgtggcaatgtcatggggtttgggggtgacccgtgaaatgacttcatagct

SEQ ID NO: 435606 - DNA, 2420 bp, Homo sapiens
tgattgcatttagactagctacttcataaacagccccaccaagaaaagaaaaatcgcgatcccgatataaaccattcagcattcaattcctttctcctagtaaaaagaggcaggtagagttttgggtctaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttattttgcatactccttgaaatgtgactcttcagaggacagggcacctgctgtgtatgtgtggccgtgcgtgtgtactcgtggctgtgtgtgtgtgatgagacactttggaagactccagggagaagtccccaggcctggagctgccgagtgcccaggtcagcgccctggactgcttgcgcacttgctcaccgagatgatgcagttggaggttgctgatctgtgcgattgctgtagcggttgccggggaccttaagagttattttgcttctctggaaggggcctatgcttgctaggcaggcagccagtgtgtctgtttttcttggtttgctgtgggaccttgcttggcgagggggaaaatctctgggtttctggagtgggagggttcgtgcagcagctgttgactggtacatgaagcattcttttatgtttgttgaagctgatgattgacatctcccgtgggtgtgccagttcttgtggagttaagacaggatttttggaagcaaggaagttagtgggtgagcttggggatgtagctcagctatctgctggtctagtggcctctaagctatagggaggggacagagccctgagctacagatgcttgagtgggttattgtgtcggtttgctagtgcagtctggtttttaagctctaaaattgaggtattttattagaagtggatttgggttgaactcttaatttgtataagggatatattttggttggggaaatagaactgagttgctaattcttattgtactcattactccatacaagaatgttatgttgaataataaaattggagaagatttcattttgtgtttccagggagtattctgtgtggggaactgtttccttacgtgaggccggcggcataagtcaaagatgagttttgtccttgcgaatcacacagattgagtctgtgttccccagggtgtgccgttacctgatttttaagtgagccagggcggacagcagcttttctgatttacagagttcttcagatttacaaatggacaatgacatcacagtttttagcactgaagccagtctcatgctagtaacagtgggtgagccgctcgagggactgggttctaatgaatactggtatgaacggggagtctctgcagtcgccagacaaatcatactcagccccttcccccgtagagcaacaagtggttcttttagagttgactggcagcatttcctgtcgggggaggtggggtttgatggagttagaaagctcgcctctgtgtacattctctcctgggctgttactttctgtagacgcacaaaatcagccccaatgtttttaagggcatcttagccaaggaagctggcttttgtgtcgccacttccaggcctgcattaagagagagcccaggcaccagggctaccactggaacctgcctcagcgtcaactgctgctggtctgtagccaggcccagcctttgagacgggtttactgtcaccagtagcctctcagtgccagccctgagctgctcctggctcagctgcccagagcctgcagcctggggaggtactcagcctctgggagacgagggccgtggactgggtggctggtagctcctgcgtttttgagctgtgtcctggctggctgctgccaatgaggtggacaccagtgtggtttggggtgcactggccacttcttgctgggttctgattttcttggaagtgcatctgccttccttatccaatagttttatccctgcattgctcttgtgaagtggctggtttggttctgtatgtagcattttgtacctttcctctggcaaaacactgtcagtttataaacattttttatatttccctcctttaaaaacagcttgtgtatttctgctataaaatgtgtcagcaaaggcagagtgacctaatagggcatgttcttaagcacagggactgtatcatgcaggggccaataaagctcaagaaaacgagtaaagcatca

SEQ ID NO: 435607 - DNA, 1416 bp, Homo sapiens
  misc_feature (1302)..(1302): n is a, c, g, or t
  misc_feature (1314)..(1314): n is a, c, g, or t
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcactcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccaganggcatgaaaggntgagaacatttgactttccttgcaaaccttgggataagatcactttccttttcttttaaggaaaaggaaaaggcccccaaaagagccccaatggaggtccca

SEQ ID NO: 435608 - DNA, 1010 bp, Homo sapiens
agcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccaggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagtgcactccagcctgggcaacaagagcaaaactgtctca

SEQ ID NO: 435609 - DNA, 691 bp, Homo sapiens
aaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggtaaggcttaaaataacgtgcttctccgttctgcagcacttggctgaggtgccagcagggaatgggaaggactctgataggacaaagcacagcaggtttcagagcaaggagagatgttttgaccttcgtgatcaaaagaacctggctttgatagttccatcatctcaaatgtctcctatagaaatatttgtggtgaaagtgtttgatgttctaattctcttttgaataaggaagagtatttctggtgggactttgtcattaaaactgtttcttattaagttattataacagttattcacctaattttaggactgcttatgattagtattaaaaactcataccaacttaagaatgttaatcttttgatattctcacttaccagctgtggtttaatttaatgctgttaaaaactgctgatgagaattgataatgttggttagttagctagcttatctacgcttgacttttaagaatgctaggcaaattggtaattacttaaataaaacggtagttataataatatgacacaaaaatt

SEQ ID NO: 435610 - DNA, 683 bp, Homo sapiens
ggcatttttccagctttatgttctctgagcttcctgggtctgcagtttggtgtctgacaagtgtttgggaaaattctcagtcattattgcttcaaatatttcttctgttattttctctcttatcctgatatgttacacattttgtagttatcccacagttcttagatattctattctgggtttttttgaagcttttttctttttgcttttcagtcttggaagtttctgttgacatatcttcaagttccaagattctttcttcagccatgtccagtctcctgatgagcccactgaaggcatttttcatttcagttacagtgtttttgagctctggcattttttaaattctttcttagaatttccatctctgtgcctatatgatccatctgttattttaatcaaaattatacatgcacagaggtacctggtgacaccaattcttttgccataatctctttttcacattgtgtaacttggtcctgaattagagatttctctctctttcacaagcataatgtcagattctatagttttcaagaaacttcagaatgtctttgtgagaacagtgagagagttgtgttctcattctagccaagaaaaaaaaagatactaaatatcaacactaaaactgaaaacacagcaccaagcaatttagagaatttgattaattttgtacattaaac

SEQ ID NO: 435611 - DNA, 631 bp, Homo sapiens
  misc_feature (580)..(580): n is a, c, g, or t
  misc_feature (583)..(583): n is a, c, g, or t
  misc_feature (592)..(592): n is a, c, g, or t
  misc_feature (594)..(595): n is a, c, g, or t
ggcatttttccagctttatgttctctgagcttcctgggtctgcagtttggtgtctgacaagtgtttgggaaaattctcagtcattattgcttcaaatatttcttctgttattttctctcttatcctgatatgttacacattttgtagttatcccacagttcttagatattctattctgggtttttttgaagcttttttctttttgcttttcagtcttggaagtttctgttgacatatcttcaagttccaagattctttcttcagccatgtccagtctcctgatgagcccactgaaggcatttttcatttcagttacagtgtttttgagctctggcattttttaaattctttcttagaatttccatctctgtgcctatatgatccatctgttattttaatcaaaattatacatgcacagaggtacctggtgacaccaattcttttgccataatctctttttcacattgtgtaacttggtcctgaattagagatttctctctctttcacaagcataatgtcagattctatagttttcaagaaacttcagaatgtctttgtgagaacaggaaaaagtggtttnctnccgagtttncnnaaaaaaacctatccctctttccagtgctgctctccc

SEQ ID NO: 435612 - DNA, 2948 bp, Homo sapiens
gacagaaggttgaacgactgcccacttatgcactgagccttccggagggacgagtctacaggggtcgcgcgtcgtaacgacgtcacttccgtcggaaggttctcatgaggagccactcagattcctgtcacttctcaaagcatctccgtcgtgaacatggccctgccaccattcttcggccagggtcgcccaggcccaccgcccccgcagccgccgcctcctgctcctttcggctgtccgccaccgccgctgccctccccggctttcccgccgcctctcccccagcggcccggcccttttccgggggcctccgcccccttccttcagcctccgctggctctgcagccccgagcctccgcggaggcctcccgcggcggaggcggcgctggcgccttctacccggtgccaccaccgccgctgcctcctccgccgccccagtgtcggcccttcccggggaccgacgccggcgagcggccgcggccaccgcctcccggcccggggccgccctggagcccgcggtggcctgaggcgccgccgccgccggccgacgtgctcggggatgcggccctccaacgcctgcgcgaccggcagtggctggaggcggtgttcgggaccccgcggcgggcaggctgtccggtgccccagcgcacgcatgccgggcccagccttggcgaagtgcgcgcgcgattgctccgggctctgcgcctggtgcggcggctgcgcggcctgagccaggccctgcgcgaggccgaagccgacggcgcggcctgggtcctgctgtactcccagaccgcgccgctgcgcgcggaactggccgagcggctacagccgttgacccaggctgcctatgtgggcgaggcgcggaggaggctggagagggtccggcgccgccggctgcggcttcgcgagagggcccgggaacgcgaggccgagcgggaggcagaggccgcgcgggcagtggaacgcgagcaggagattgaccgctggagggtgaagtgtgtgcaggaggtggaggagaagaagcgggagcaggaactcaaagcagccgctgatggcgtactatctgaagtgaggaaaaaacaagcagataccaaaagaatggtggacattctacgggctttggagaaattgaggaaactgaggaaagaggctgcagcgaggaaaggggtctgtcctccagcctcagcagatgagacttttacgcatcatcttcagcgactgagaaaactcattaaaaagcgctctgaactgtatgaagctgaagagagagccctcagagttatgctagaaggagaacaagaggaagagaggaaaagagaattagaaaagaaacaaagaaaagaaaaagagaaaattttacttcagaaacgtgaaattgagtccaagttgtttggggatccagatgagttcccacttgctcacctcttggagcctttccgacagtattatctccaagccgagcactccctgccagcgctcatccagatcaggcatgattgggatcagtacctggtgccatccgatcatcccaaaggcaacttcgttccccaaggatgggtccttcccccgctccccagcaacgacatctgggcaactgctgttaagctgcattagtaaagatgctccaggagtgtggtccagccagcgctctttccagctgtaaatattagcgatggtgccatcttttgctgtagactaaactgcaacttctaaattccatgtggcattcccctaccctgaagttatgctttccttctgtgctctgtgctggccagaggtgcctcttgaatcagattaatgtggtttttcaggaaaggacttaggtgaactgaggtttttaccacaggcagtgaatgaccttggttcaccaaatttgcctctgttttgaggggcttggtccagagtgacttgttaatttactctaacttccttgtgtgttgatgggtaagtacactcaaacactgaatacaggtgtgtgatgggtagatttcacagcccttctactaatagtgagtgtgaaggcaagcttgatgcaaaacctcctgacctttcctacctgaagagccctttgacttctaggaagaaaggtcaaaaatgttatcttcagttgtgttaatcccagttttagtgcagcttaggaggctgctagttaggaagatggcagtggctgtaggctgggttgccagaaaagatggtggcctagtcttattattcagatggagaacttagaaaacctgaagagtacccaaattggattgtattttaatggacaatggctgtattttttccatgttagaaggatcctaatgaaagcacctgttatttttaagtttctaagggtctagttgttcagaatccccaaggatatttccctaacctcactcagtcacattgtaggagccagtgtagctatggaattatcttaggaactcaagcttctaaaactatccatgtagtcaaatctaggggaaaaagcaaataaaaatagtaaaatttggccgggcacagtggctcacgcctgtaatcccaacactttgggaggccgaggcgggccgatcacgaggtcaggagatcaaggccatcctggctaacacggtgaaaccctgtctctactaaaaatacaaaaaaatattagctgggcgtaggtggtgcacacctgtagtcccagctactggggaggctgaggcaggagaatggtgtaaaacccaggaggcagagcttgcagtgagccgagatcgcgccacggcactccagcctgggagacagagcaagactccgtctcaaaaaaaaaaaaagtaaaatttattttttatattcattaataaatgctgttgtgcttggagatgatcactcatataacatgtcatttttttggttctgttttggtttggtttttgccaattattttgttatatttccaaaaaactaaataaaaatcatttttattt

SEQ ID NO: 435613 - DNA, 2331 bp, Homo sapiens
gacagaaggttgaacgactgcccacttatgcactgagccttccggagggacgagtctacaggggtcgcgcgtcgtaacgacgtcacttccgtcggaaggttctcatgaggagccactcagattcctgtcacttctcaaagcatctccgtcgtgaacatggccctgccaccattcttcggccagggtcgcccaggcccaccgcccccgcagccgccgcctcctgctcctttcggctgtccgccaccgccgctgccctccccggctttcccgccgcctctcccccagcggcccggcccttttccgggggcctccgcccccttccttcagcctccggcgggcagtggaacgcgagcaggagattgaccgctggagggtgaagtgtgtgcaggaggtggaggagaagaagcgggagcaggaactcaaagcagccgctgatggcgtactatctgaagtgaggaaaaaacaagcagataccaaaagaatggtggacattctacgggctttggagaaattgaggaaactgaggaaagaggctgcagcgaggaaaggggtctgtcctccagcctcagcagatgagacttttacgcatcatcttcagcgactgagaaaactcattaaaaagcgctctgaactgtatgaagctgaagagagagccctcagagttatgctagaaggagaacaagaggaagagaggaaaagagaattagaaaagaaacaaagaaaagaaaaagagaaaattttacttcagaaacgtgaaattgagtccaagttgtttggggatccagatgagttcccacttgctcacctcttggagcctttccgacagtattatctccaagccgagcactccctgccagcgctcatccagatcaggcatgattgggatcagtacctggtgccatccgatcatcccaaaggcaacttcgttccccaaggatgggtccttcccccgctccccagcaacgacatctgggcaactgctgttaagctgcattagtaaagatgctccaggagtgtggtccagccagcgctctttccagctgtaaatattagcgatggtgccatcttttgctgtagactaaactgcaacttctaaattccatgtggcattcccctaccctgaagttatgctttccttctgtgctctgtgctggccagaggtgcctcttgaatcagattaatgtggtttttcaggaaaggacttaggtgaactgaggtttttaccacaggcagtgaatgaccttggttcaccaaatttgcctctgttttgaggggcttggtccagagtgacttgttaatttactctaacttccttgtgtgttgatgggtaagtacactcaaacactgaatacaggtgtgtgatgggtagatttcacagcccttctactaatagtgagtgtgaaggcaagcttgatgcaaaacctcctgacctttcctacctgaagagccctttgacttctaggaagaaaggtcaaaaatgttatcttcagttgtgttaatcccagttttagtgcagcttaggaggctgctagttaggaagatggcagtggctgtaggctgggttgccagaaaagatggtggcctagtcttattattcagatggagaacttagaaaacctgaagagtacccaaattggattgtattttaatggacaatggctgtattttttccatgttagaaggatcctaatgaaagcacctgttatttttaagtttctaagggtctagttgttcagaatccccaaggatatttccctaacctcactcagtcacattgtaggagccagtgtagctatggaattatcttaggaactcaagcttctaaaactatccatgtagtcaaatctaggggaaaaagcaaataaaaatagtaaaatttggccgggcacagtggctcacgcctgtaatcccaacactttgggaggccgaggcgggccgatcacgaggtcaggagatcaaggccatcctggctaacacggtgaaaccctgtctctactaaaaatacaaaaaaatattagctgggcgtaggtggtgcacacctgtagtcccagctactggggaggctgaggcaggagaatggtgtaaaacccaggaggcagagcttgcagtgagccgagatcgcgccacggcactccagcctgggagacagagcaagactccgtctcaaaaaaaaaaaaagtaaaatttattttttatattcattaataaatgctgttgtgcttggagatgatcactcatataacatgtcatttttttggttctgttttggtttggtttttgccaattattttgttatatttccaaaaaactaaataaaaatcatttttattt

SEQ ID NO: 435614 - DNA, 2279 bp, Homo sapiens
cttcaggtctagggaatctgcatttttaacaagtctcagcttaacaaggtaagttggacacctgatctctgcactacactttgagaaacactgaggaagaaacaaaaccagtgctatgtggaagatacagagaggagaggttctcctttaagatgaaggttgtaccatcagtggagggggataacctcttagctagaggggagttgtgcaaggcctaagaaattgggatggagattcaatagagtctctcttaacctggagactgtctgatcctttaaaatctaaccactgggcagctattctctgctgtaagtttgttcctaatacgaggtctcatgggctttgtttctcttccaggagcaggaactcaaagcagccgctgatggcgtactatctgaagtgaggaaaaaacaagcagataccaaaagaatggtggacattctacgggctttggagaaattgaggaaactgaggaaagaggctgcagcgaggaaaggggtctgtcctccagcctcagcagatgagacttttacgcatcatcttcagcgactgagaaaactcattaaaaagcgctctgaactgtatgaagctgaagagagagccctcagagttatgctagaaggagaacaagaggaagagaggaaaagagaattagaaaagaaacaaagaaaagaaaaagagaaaattttacttcagaaacgtgaaattgagtccaagttgtttggggatccagatgagttcccacttgctcacctcttggagcctttccgacagtattatctccaagccgagcactccctgccagcgctcatccagatcaggcatgattgggatcagtacctggtgccatccgatcatcccaaaggcaacttcgttccccaaggatgggtccttcccccgctccccagcaacgacatctgggcaactgctgttaagctgcattagtaaagatgctccaggagtgtggtccagccagcgctctttccagctgtaaatattagcgatggtgccatcttttgctgtagactaaactgcaacttctaaattccatgtggcattcccctaccctgaagttatgctttccttctgtgctctgtgctggccagaggtgcctcttgaatcagattaatgtggtttttcaggaaaggacttaggtgaactgaggtttttaccacaggcagtgaatgaccttggttcaccaaatttgcctctgttttgaggggcttggtccagagtgacttgttaatttactctaacttccttgtgtgttgatgggtaagtacactcaaacactgaatacaggtgtgtgatgggtagatttcacagcccttctactaatagtgagtgtgaaggcaagcttgatgcaaaacctcctgacctttcctacctgaagagccctttgacttctaggaagaaaggtcaaaaatgttatcttcagttgtgttaatcccagttttagtgcagcttaggaggctgctagttaggaagatggcagtggctgtaggctgggttgccagaaaagatggtggcctagtcttattattcagatggagaacttagaaaacctgaagagtacccaaattggattgtattttaatggacaatggctgtattttttccatgttagaaggatcctaatgaaagcacctgttatttttaagtttctaagggtctagttgttcagaatccccaaggatatttccctaacctcactcagtcacattgtaggagccagtgtagctatggaattatcttaggaactcaagcttctaaaactatccatgtagtcaaatctaggggaaaaagcaaataaaaatagtaaaatttggccgggcacagtggctcacgcctgtaatcccaacactttgggaggccgaggcgggccgatcacgaggtcaggagatcaaggccatcctggctaacacggtgaaaccctgtctctactaaaaatacaaaaaaatattagctgggcgtaggtggtgcacacctgtagtcccagctactggggaggctgaggcaggagaatggtgtaaaacccaggaggcagagcttgcagtgagccgagatcgcgccacggcactccagcctgggagacagagcaagactccgtctcaaaaaaaaaaaaagtaaaatttattttttatattcattaataaatgctgttgtgcttggagatgatcactcatataacatgtcatttttttggttctgttttggtttggtttttgccaattattttgttatatttccaaaaaactaaataaaaatcatttttattt

SEQ ID NO: 435615 - DNA, 2042 bp, Homo sapiens
cttcaggtctagggaatctgcatttttaacaagtctcagcttaacaaggtaagttggacacctgatctctgcactacactttgagaaacactgaggaagaaacaaaaccagtgctatgtggaagatacagagaggagaggttctcctttaagatgaaggttgtaccatcagtggagggggataacctcttagctagaggggagttgtgcaaggcctaagaaattgggatggagattcaatagagtctctcttaacctggagactgtctgatcctttaaaatctaaccactgggcagctattctctgctgtaagtttgttcctaatacgaggtctcatgggctttgtttctcttccaggagcaggaactcaaagcagccgctgatggcgtactatctgaagtgaggaaaaaacaagcagataccaaaagaatggtggacattctacgggctttggagaaattgaggaaactgaggaaagaggctgcagcgaggaaagatgagttcccacttgctcacctcttggagcctttccgacagtattatctccaagccgagcactccctgccagcgctcatccagatcaggcatgattgggatcagtacctggtgccatccgatcatcccaaaggcaacttcgttccccaaggatgggtccttcccccgctccccagcaacgacatctgggcaactgctgttaagctgcattagtaaagatgctccaggagtgtggtccagccagcgctctttccagctgtaaatattagcgatggtgccatcttttgctgtagactaaactgcaacttctaaattccatgtggcattcccctaccctgaagttatgctttccttctgtgctctgtgctggccagaggtgcctcttgaatcagattaatgtggtttttcaggaaaggacttaggtgaactgaggtttttaccacaggcagtgaatgaccttggttcaccaaatttgcctctgttttgaggggcttggtccagagtgacttgttaatttactctaacttccttgtgtgttgatgggtaagtacactcaaacactgaatacaggtgtgtgatgggtagatttcacagcccttctactaatagtgagtgtgaaggcaagcttgatgcaaaacctcctgacctttcctacctgaagagccctttgacttctaggaagaaaggtcaaaaatgttatcttcagttgtgttaatcccagttttagtgcagcttaggaggctgctagttaggaagatggcagtggctgtaggctgggttgccagaaaagatggtggcctagtcttattattcagatggagaacttagaaaacctgaagagtacccaaattggattgtattttaatggacaatggctgtattttttccatgttagaaggatcctaatgaaagcacctgttatttttaagtttctaagggtctagttgttcagaatccccaaggatatttccctaacctcactcagtcacattgtaggagccagtgtagctatggaattatcttaggaactcaagcttctaaaactatccatgtagtcaaatctaggggaaaaagcaaataaaaatagtaaaatttggccgggcacagtggctcacgcctgtaatcccaacactttgggaggccgaggcgggccgatcacgaggtcaggagatcaaggccatcctggctaacacggtgaaaccctgtctctactaaaaatacaaaaaaatattagctgggcgtaggtggtgcacacctgtagtcccagctactggggaggctgaggcaggagaatggtgtaaaacccaggaggcagagcttgcagtgagccgagatcgcgccacggcactccagcctgggagacagagcaagactccgtctcaaaaaaaaaaaaagtaaaatttattttttatattcattaataaatgctgttgtgcttggagatgatcactcatataacatgtcatttttttggttctgttttggtttggtttttgccaattattttgttatatttccaaaaaactaaataaaaatcatttttattt

SEQ ID NO: 435616 - DNA, 1516 bp, Homo sapiens
agataatactgtcggaaaggctccaagaggtgagcaagtgggaactcatctagatcaggcatgattgggatcagtacctggtgccatccgatcatcccaaaggcaacttcgttccccaaggatgggtccttcccccgctccccagcaacgacatctgggcaactgctgttaagctgcattagtaaagatgctccaggagtgtggtccagccagcgctctttccagctgtaaatattagcgatggtgccatcttttgctgtagactaaactgcaacttctaaattccatgtggcattcccctaccctgaagttatgctttccttctgtgctctgtgctggccagaggtgcctcttgaatcagattaatgtggtttttcaggaaaggacttaggtgaactgaggtttttaccacaggcagtgaatgaccttggttcaccaaatttgcctctgttttgaggggcttggtccagagtgacttgttaatttactctaacttccttgtgtgttgatgggtaagtacactcaaacactgaatacaggtgtgtgatgggtagatttcacagcccttctactaatagtgagtgtgaaggcaagcttgatgcaaaacctcctgacctttcctacctgaagagccctttgacttctaggaagaaaggtcaaaaatgttatcttcagttgtgttaatcccagttttagtgcagcttaggaggctgctagttaggaagatggcagtggctgtaggctgggttgccagaaaagatggtggcctagtcttattattcagatggagaacttagaaaacctgaagagtacccaaattggattgtattttaatggacaatggctgtattttttccatgttagaaggatcctaatgaaagcacctgttatttttaagtttctaagggtctagttgttcagaatccccaaggatatttccctaacctcactcagtcacattgtaggagccagtgtagctatggaattatcttaggaactcaagcttctaaaactatccatgtagtcaaatctaggggaaaaagcaaataaaaatagtaaaatttggccgggcacagtggctcacgcctgtaatcccaacactttgggaggccgaggcgggccgatcacgaggtcaggagatcaaggccatcctggctaacacggtgaaaccctgtctctactaaaaatacaaaaaaatattagctgggcgtaggtggtgcacacctgtagtcccagctactggggaggctgaggcaggagaatggtgtaaaacccaggaggcagagcttgcagtgagccgagatcgcgccacggcactccagcctgggagacagagcaagactccgtctcaaaaaaaaaaaaagtaaaatttattttttatattcattaataaatgctgttgtgcttggagatgatcactcatataacatgtcatttttttggttctgttttggtttggtttttgccaattattttgttatatttccaaaaaactaaataaaaatcatttttattt

SEQ ID NO: 435617 - DNA, 1434 bp, Homo sapiens
gacagaaggttgaacgactgcccacttatgcactgagccttccggagggacgagtctacaggggtcgcgcgtcgtaacgacgtcacttccgtcggaaggttctcatgaggagccactcagattcctgtcacttctcaaagcatctccgtcgtgaacatggccctgccaccattcttcggccagggtcgcccaggcccaccgcccccgcagccgccgcctcctgctcctttcggctgtccgccaccgccgctgccctccccggctttcccgccgcctctcccccagcggcccggcccttttccgggggcctccgcccccttccttcagcctccgctggctctgcagccccgagcctccgcggaggcctcccgcggcggaggcggcgctggcgccttctacccggtgccaccaccgccgctgcctcctccgccgccccagtgtcggcccttcccggggaccgacgccggcgagcggccgcggccaccgcctcccggcccggggccgccctggagcccgcggtggcctgaggcgccgccgccgccggccgacgtgctcggggatgcggccctccaacgcctgcgcgaccggcagtggctggaggcggtgttcgggaccccgcggcgggcaggctgtccggtgccccagcgcacgcatgccgggcccagccttggcgaagtgcgcgcgcgattgctccgggctctgcgcctggtgcggcggctgcgcggcctgagccaggccctgcgcgaggccgaagccgacggcgcggcctgggtcctgctgtactcccagaccgcgccgctgcgcgcggaactggccgagcggctacagccgttgacccaggctgcctatgtgggcgaggcgcggaggaggctggagagggtccggcgccgccggctgcggcttcgcgagagggcccgggaacgcgaggccgagcgggaggcagaggccgcgcgggcagtggaacgcgagcaggagattgaccgctggagggtgaagtgtgtgcaggaggtggaggagaagaagcgggagcaggaactcaaagcagccgctgatggcgtactatctgaagtgaggaaaaaacaagcagataccaaaagaatggtggacattctacgggctttggagaaattgaggaaactgaggaaagaggctgcagcgaggaaaggggtctgtcctccagcctcagcagatgagacttttacgcatcatcttcagcgactgagaaaactcattaaaaagcgctctgaactgtatgaagctgaagagagagccctcagagttatgctagaaggagaacaagaggaagagaggaaaagagaattagaaaagaaacaaagaaaagaaaaagagaaaattttacttcagaaacgtgaaattgagtccaagttgtttggggatccaggtatgttgctctataaccagtggagaaaatga

SEQ ID NO: 435618 - DNA, 268 bp, Homo sapiens
agtcattttcttgattcctagaaatcaagttctgtaatagattagtatatcagtcatttgaaagctaagtcttagaatatgtagttgctgaacatcttatttggaataaaacagaaataaatagttgttctataatgttcttattaaggcatgattgggatcagtacctggtgccatccgatcatcccaaaggcaacttcgttccccaaggatgggtccttcccccgctccccagcaacgacatctgggcaactgctgttaagctgca

SEQ ID NO: 435619 - DNA, 606 bp, Homo sapiens
atctgaaaataaaaaataaaaaataaaaaaaagccaggcatggtggtgcacacttgtacttgtagctacttgggaagccaaggtgggaggatgggttgagcccaggagtttgaagttgcagtgagctatgatcacaccactgtactccagcctgggtgttagagcgaggccttgtctcaaaaaaaaaaataaataaaatgccattttgtcctgtctgcccagggggtctgtcctccagcctcagcagatgagacttttacgcatcatcttcagcgactgagaaaactcattaaaaagcgctctgaactgtatgaagctgaagagagagccctcagagttatgctagaaggagaacaagaggaagagaggaaaagagaattagaaaagaaacaaagaaaagaaaaagagaaaattttacttcagaaacgtgaaattgagtccaagttgtttggggatccaggtatgttgctctataaccagtggagaaaatgaaaatactagattgacgctcttctcatcacgggtgatctcaagctaagaggtggtaggcaacaaatgacaccttccagatgcaattctgtgtcatagaactcatggatacagata

SEQ ID NO: 435620 - DNA, 2104 bp, Homo sapiens
  misc_feature (916)..(916): n is a, c, g, or t
  misc_feature (1508)..(1508): n is a, c, g, or t
  misc_feature (1533)..(1534): n is a, c, g, or t
  misc_feature (1603)..(1603): n is a, c, g, or t
aggatacagagatcatatacacctctatttacccttcagaggagcatgaccagcaaccactggaagctttatgtctacctgtcaataatagttcgatgatgcgatcagatgtcacttaaatctgtgaaagtagtcgtagagcccactgattaaacctttggctgtgctttgatatgtatgtaaataaattctctaactggcgttggaaaaaccctacaaatgtaaagaatgtggaaaagcttttcaccgatactcaatccttagtacacataagaaaattcatactggggagaaaccccacaaatgtggagaatgcggaaaagcctttaactggtcctcaactcttattacacataagataattcacagtggagaaaaaccctacaaatatgaagaatgtggcaaagcttttaaccagtcctcacaccttatgagacataagaaaattcatagtaaagagaaaccttacaaatgtgaacagtgtggcaaggtctttaagaagtcctcaactcttactgcacataagatcattcatactggagagaaaccttacaaatgtgaggaatgtggcaaaggttttagccaactctcaaaccttactaaacacaagaagattcatactagagagaaaccctacaaacgtgaagaatgtggcatatcttttaaccagttctcacaacttgctatacataagatgattcacacttgaatgaaaccctacaaatgtgaacgatgtggcagttgttttaactagttctcgaactttactatgcataagaaaattcaaactggagagaaactctacaaatgtgaagaatgtggcaaagcttttaaccaagtctcaacacttactatacataagataatttatactggagcaaaaccttggaaattcaaagaatgtggtaaaacttanaatcctcaaaacttcttacacctaaaattcatgcaggagagaaaccccacaaatgtgaaaaatttggtaaattctttaacaagtcttcaaccctttctgcacataatataattcatactggagagaaaccccacaaatatgaagaatgtggtaatgcttttaaccaattctcaaatcttactaaacaaaattaatactgaaaatgttacaaaccagaaaaatgtgaaaatgattttaacaaaaccttcaaatttttctaaacataaaggaaatcatactggtaagaaattataaaaatgtgaagaatgtgacaaagcctttaaatggttgtcacacttgattgtaggtaagataattcatactggcagaaactcccagaagtgtgaagaatatggcaaaactttaattcctataccttattgcacaggaaagcatttatacttcagaaaatgttgtactgatataaagaatgtagaaaagccattaatatgtgcttacatcttattcaacattagagagttagtacttaataaaagcattataaatgcaattactgtcaaaactcagtataaggttttgttttagtgtgtgntttgtttgtttgtttgttttgtttnnttttttttaaatgagactacgtaatactctctcccaggctggagtgcactggtgcaatcttggtttacngtaacctctgccttccaggttcaagcaattctcctgcctgggcctccagaatagctgggactacaggcatgtgccatcacgcccggctaagttttgtattttttagtagagacagggttttactgtgttggccaggctcatctcgaactcctgacttgaaatgatccatacacctctgcctcccaaagtgctggaataacaggtgtgagccactgttcccagccaatataagcctttaaagtaaaaaaagagtttttattttgaagacaaacattagaaacataaagagggttgtagtgcctgccttacttgtatcacagatcttattgtacacattttgtatccgaagcagttgctccaaacttcgttcaacatcagggaatttatatcggagaaaaactacaaatgtaatacatttcaaaaatttttcaaaaactacatcttagaaaacaccaggggatgcatactaaactatatttttccacatgcagtaaatataaa

SEQ ID NO: 435621 - DNA, 1845 bp, Homo sapiens
  misc_feature (22)..(22): n is a, c, g, or t
  misc_feature (58)..(59): n is a, c, g, or t
  misc_feature (657)..(657): n is a, c, g, or t
  misc_feature (1249)..(1249): n is a, c, g, or t
  misc_feature (1274)..(1275): n is a, c, g, or t
  misc_feature (1344)..(1344): n is a, c, g, or t
atctgtgatacaagtaaggcangcactacaaccctctttatgtttctaatgtttgtcnncaaaataaaaactctttttttactttaaaggcttatattggctgggaacagtggagaaaaaccctacaaatatgaagaatgtggcaaagcttttaaccagtcctcacaccttatgagacataagaaaattcatagtaaagagaaaccttacaaatgtgaacagtgtggcaaggtctttaagaagtcctcaactcttactgcacataagatcattcatactggagagaaaccttacaaatgtgaggaatgtggcaaaggttttagccaactctcaaaccttactaaacacaagaagattcatactagagagaaaccctacaaacgtgaagaatgtggcatatcttttaaccagttctcacaacttgctatacataagatgattcacacttgaatgaaaccctacaaatgtgaacgatgtggcagttgttttaactagttctcgaactttactatgcataagaaaattcaaactggagagaaactctacaaatgtgaagaatgtggcaaagcttttaaccaagtctcaacacttactatacataagataatttatactggagcaaaaccttggaaattcaaagaatgtggtaaaacttanaatcctcaaaacttcttacacctaaaattcatgcaggagagaaaccccacaaatgtgaaaaatttggtaaattctttaacaagtcttcaaccctttctgcacataatataattcatactggagagaaaccccacaaatatgaagaatgtggtaatgcttttaaccaattctcaaatcttactaaacaaaattaatactgaaaatgttacaaaccagaaaaatgtgaaaatgattttaacaaaaccttcaaatttttctaaacataaaggaaatcatactggtaagaaattataaaaatgtgaagaatgtgacaaagcctttaaatggttgtcacacttgattgtaggtaagataattcatactggcagaaactcccagaagtgtgaagaatatggcaaaactttaattcctataccttattgcacaggaaagcatttatacttcagaaaatgttgtactgatataaagaatgtagaaaagccattaatatgtgcttacatcttattcaacattagagagttagtacttaataaaagcattataaatgcaattactgtcaaaactcagtataaggttttgttttagtgtgtgntttgtttgtttgtttgttttgtttnnttttttttaaatgagactacgtaatactctctcccaggctggagtgcactggtgcaatcttggtttacngtaacctctgccttccaggttcaagcaattctcctgcctgggcctccagaatagctgggactacaggcatgtgccatcacgcccggctaagttttgtattttttagtagagacagggttttactgtgttggccaggctcatctcgaactcctgacttgaaatgatccatacacctctgcctcccaaagtgctggaataacaggtgtgagccactgttcccagccaatataagcctttaaagtaaaaaaagagtttttattttgaagacaaacattagaaacataaagagggttgtagtgcctgccttacttgtatcacagatcttattgtacacattttgtatccgaagcagttgctccaaacttcgttcaacatcagggaatttatatcggagaaaaactacaaatgtaatacatttcaaaaatttttcaaaaactacatcttagaaaacaccaggggatgcatactaaactatatttttccacatgcagtaaatataaa

SEQ ID NO: 435622 - DNA, 2924 bp, Homo sapiens
  misc_feature (1736)..(1736): n is a, c, g, or t
  misc_feature (2328)..(2328): n is a, c, g, or t
  misc_feature (2353)..(2354): n is a, c, g, or t
  misc_feature (2423)..(2423): n is a, c, g, or t
tactactactaaattcgcgcccgggtcgacggaatatgaagagacatgagatggtggtagccaaacattcagctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttataatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaacaacttactgaacataagaaaatttacactagagagaaagcctacaaatgtgaagaatgtggcaaagcctttaaccagttttcaacccttattacacataagataattcatagcagagagaaaccccacaaatgtgaagaatgtggcagagcttttaaccagtccgcaaagctcactgaacataagttaattcatactggagaaaaaccctacaaatgtaaagaatgtggaaaagcttttcaccgatactcaatccttagtacacataagaaaattcatactggggagaaaccccacaaatgtggagaatgcggaaaagcctttaactggtcctcaactcttattacacataagataattcacagtggagaaaaaccctacaaatatgaagaatgtggcaaagcttttaaccagtcctcacaccttatgagacataagaaaattcatagtaaagagaaaccttacaaatgtgaacagtgtggcaaggtctttaagaagtcctcaactcttactgcacataagatcattcatactggagagaaaccttacaaatgtgaggaatgtggcaaaggttttagccaactctcaaaccttactaaacacaagaagattcatactagagagaaaccctacaaacgtgaagaatgtggcatatcttttaaccagttctcacaacttgctatacataagatgattcacacttgaatgaaaccctacaaatgtgaacgatgtggcagttgttttaactagttctcgaactttactatgcataagaaaattcaaactggagagaaactctacaaatgtgaagaatgtggcaaagcttttaaccaagtctcaacacttactatacataagataatttatactggagcaaaaccttggaaattcaaagaatgtggtaaaacttanaatcctcaaaacttcttacacctaaaattcatgcaggagagaaaccccacaaatgtgaaaaatttggtaaattctttaacaagtcttcaaccctttctgcacataatataattcatactggagagaaaccccacaaatatgaagaatgtggtaatgcttttaaccaattctcaaatcttactaaacaaaattaatactgaaaatgttacaaaccagaaaaatgtgaaaatgattttaacaaaaccttcaaatttttctaaacataaaggaaatcatactggtaagaaattataaaaatgtgaagaatgtgacaaagcctttaaatggttgtcacacttgattgtaggtaagataattcatactggcagaaactcccagaagtgtgaagaatatggcaaaactttaattcctataccttattgcacaggaaagcatttatacttcagaaaatgttgtactgatataaagaatgtagaaaagccattaatatgtgcttacatcttattcaacattagagagttagtacttaataaaagcattataaatgcaattactgtcaaaactcagtataaggttttgttttagtgtgtgntttgtttgtttgtttgttttgtttnnttttttttaaatgagactacgtaatactctctcccaggctggagtgcactggtgcaatcttggtttacngtaacctctgccttccaggttcaagcaattctcctgcctgggcctccagaatagctgggactacaggcatgtgccatcacgcccggctaagttttgtattttttagtagagacagggttttactgtgttggccaggctcatctcgaactcctgacttgaaatgatccatacacctctgcctcccaaagtgctggaataacaggtgtgagccactgttcccagccaatataagcctttaaagtaaaaaaagagtttttattttgaagacaaacattagaaacataaagagggttgtagtgcctgccttacttgtatcacagatcttattgtacacattttgtatccgaagcagttgctccaaacttcgttcaacatcagggaatttatatcggagaaaaactacaaatgtaatacatttcaaaaatttttcaaaaactacatcttagaaaacaccaggggatgcatactaaactatatttttccacatgcagtaaatataaa

SEQ ID NO: 435623 - DNA, 3031 bp, Homo sapiens
  misc_feature (1843)..(1843): n is a, c, g, or t
  misc_feature (2435)..(2435): n is a, c, g, or t
  misc_feature (2460)..(2461): n is a, c, g, or t
  misc_feature (2530)..(2530): n is a, c, g, or t
ggacatgacgtcttccgggatgcggcggggtctttgtctcgctgcagcgggtgctgcaggtctggccttcacttttctgcgtcctcttactcctagaggcccagcctctgtggcgctgtgatctggttatcgggagattcacagctaagacgccaggatcccccggaagcctagaaatgctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttataatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaacaacttactgaacataagaaaatttacactagagagaaagcctacaaatgtgaagaatgtggcaaagcctttaaccagttttcaacccttattacacataagataattcatagcagagagaaaccccacaaatgtgaagaatgtggcagagcttttaaccagtccgcaaagctcactgaacataagttaattcatactggagaaaaaccctacaaatgtaaagaatgtggaaaagcttttcaccgatactcaatccttagtacacataagaaaattcatactggggagaaaccccacaaatgtggagaatgcggaaaagcctttaactggtcctcaactcttattacacataagataattcacagtggagaaaaaccctacaaatatgaagaatgtggcaaagcttttaaccagtcctcacaccttatgagacataagaaaattcatagtaaagagaaaccttacaaatgtgaacagtgtggcaaggtctttaagaagtcctcaactcttactgcacataagatcattcatactggagagaaaccttacaaatgtgaggaatgtggcaaaggttttagccaactctcaaaccttactaaacacaagaagattcatactagagagaaaccctacaaacgtgaagaatgtggcatatcttttaaccagttctcacaacttgctatacataagatgattcacacttgaatgaaaccctacaaatgtgaacgatgtggcagttgttttaactagttctcgaactttactatgcataagaaaattcaaactggagagaaactctacaaatgtgaagaatgtggcaaagcttttaaccaagtctcaacacttactatacataagataatttatactggagcaaaaccttggaaattcaaagaatgtggtaaaacttanaatcctcaaaacttcttacacctaaaattcatgcaggagagaaaccccacaaatgtgaaaaatttggtaaattctttaacaagtcttcaaccctttctgcacataatataattcatactggagagaaaccccacaaatatgaagaatgtggtaatgcttttaaccaattctcaaatcttactaaacaaaattaatactgaaaatgttacaaaccagaaaaatgtgaaaatgattttaacaaaaccttcaaatttttctaaacataaaggaaatcatactggtaagaaattataaaaatgtgaagaatgtgacaaagcctttaaatggttgtcacacttgattgtaggtaagataattcatactggcagaaactcccagaagtgtgaagaatatggcaaaactttaattcctataccttattgcacaggaaagcatttatacttcagaaaatgttgtactgatataaagaatgtagaaaagccattaatatgtgcttacatcttattcaacattagagagttagtacttaataaaagcattataaatgcaattactgtcaaaactcagtataaggttttgttttagtgtgtgntttgtttgtttgtttgttttgtttnnttttttttaaatgagactacgtaatactctctcccaggctggagtgcactggtgcaatcttggtttacngtaacctctgccttccaggttcaagcaattctcctgcctgggcctccagaatagctgggactacaggcatgtgccatcacgcccggctaagttttgtattttttagtagagacagggttttactgtgttggccaggctcatctcgaactcctgacttgaaatgatccatacacctctgcctcccaaagtgctggaataacaggtgtgagccactgttcccagccaatataagcctttaaagtaaaaaaagagtttttattttgaagacaaacattagaaacataaagagggttgtagtgcctgccttacttgtatcacagatcttattgtacacattttgtatccgaagcagttgctccaaacttcgttcaacatcagggaatttatatcggagaaaaactacaaatgtaatacatttcaaaaatttttcaaaaactacatcttagaaaacaccaggggatgcatactaaactatatttttccacatgcagtaaatataaa

SEQ ID NO: 435624 - DNA, 156 bp, Homo sapiens
gaccttaggcgatctgcccacctcggcctcccgaagtgctgggattacaggcctgagccaccgagcccagcctcagcaccatttttaaaaggtgcaaatgcatctatttctgcttgctttctttattttttaaattatttatttatttattttgag

SEQ ID NO: 435625 - DNA, 612 bp, Homo sapiens
gaaaaagaggtggagagaggagcctgcaacagaagggagaatgaaagggaaggaagagagaaaggaagggattttggtgttctgttcactgctgtatccccagaacttaaaacagagcctggtgcataataggtgtaaataactgttgaataaatgaatcaatgctacatacacacacgcacgcacacacacacagagagagagtcaaccacactcttcagaaggtggataagttaaaacaagagtttcaaacaaatatatgttcagatgccctttcctcccacttactggctggctggccttaagtaagcaacttaacctttctgttctttctgctttcttatctgcaacgagtagcatgccatagctagagtaacacggcatatagttggtcctgataaatgtagcatattttagccaccataggagtacacataataaaagctaacatgtagtatgtgcttagcttatctatgttttgtggatgtgatacaattttctgttcacttttaaatgccctgcatcttagtcaattttaacagtgattctgtaagttagataaggttaggcattattattaaatccattttacaccaagagaaacttgggtca

SEQ ID NO: 435626 - DNA, 3247 bp, Homo sapiens
aaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgaggagagtagttatggctcaccttttactccggctaagagacctaagaggaaagttgcccctaagaggagacaggaaagaccagttgctcctccaaagaaaagaagaagaaaaatacataggatggatcattatgctgcggaaactcgtcaggacaaaatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435627 - DNA, 1000 bp, Homo sapiens
tgggaatgtggatggcggcgctggacgccccgtcttcagcctcccgacactttccttccccaaagccattttagtcaaaggtcatgtgtgtgtcttgtcaaaggccagcttccaatggaatcattgtcccccgggacagcggccccctgactacatctgcactggagaaatcccaaaagcaaacggccagtgcaaacaagagcagtccgcagcagccgtcccgagcacagctcccaggtcgcggggctgcagcccaggccgcgtccgcagcgcccgggcaggaacagacgccgagactcccgcagcatgacccgccacgccgatcggataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatcccggaatcacatggcattgttgggcaattcaagtttgatcctgggatttgaatgcccactttcatcctgggaaggcgaaaagaaat

SEQ ID NO: 435628 - DNA, 3091 bp, Homo sapiens
aaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435629 - DNA, 3396 bp, Homo sapiens
aaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagttttaaaaaaagaaaaaaacaaaaaaaaaaaaaaaaaaaaaaaacaaaaaaaaaaacaaaaaaaaaatttttgggggcccctctgcgccctagaaaaagctttttaaaaccacctcgctggtgggcggcgacgccgcccactttggttgtaccagcaccggtggccataacggtgtttccccgaagagaactctcggggccaaagaaatacaggtgggtgtgtttctcccccatattatagaaagccccggggggacaccccacgttttttgtgaacacacgcgatggagtcctcacggcacaacaggc

SEQ ID NO: 435630 - DNA, 3037 bp, Homo sapiens
aaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggacgaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435631 - DNA, 3112 bp, Homo sapiens
aaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggacgaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagctgaaaccaggaaattcagaggcagcagaaatgaaaacaaggaaaacattaatggaaattttgaacctagaaaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435632 - DNA, 3267 bp, Homo sapiens
tgggaatgtggatggcggcgctggacgccccgtcttcagcctcccgacactttccttccccaaagccattttagtcaaaggtcatgtgtgtgtcttgtcaaaggccagcttccaatggaatcattgtcccccgggacagcggccccctgactacatctgcactggagaaatcccaaaagcaaacggccagtgcaaacaagagcagtccgcagcagccgtcccgagcacagctcccaggtcgcggggctgcagcccaggccgcgtccgcagcgcccgggcaggaacagacgccgagactcccgcagcatgacccgccacgccgatcggataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggacgaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435633 - DNA, 1733 bp, Homo sapiens
cccccaagcttggcacgcgggcaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435634 - DNA, 2022 bp, Homo sapiens
gaggaattccctccagaagagcagaactggacctaggagggcagtttactataggatttgttccacttgcttagctgcatgtcaatgactgaaatgttaaatacccctacacaattatttatctttcaaacaaaacactaaagtgatagtcttctgtgggatggaaggagaaagaattgagtatcttgctgcaaaaatgatttctcttggtaatggttgttatttcttttgaaatctttctcctctctttgaacagatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435635 - DNA, 1445 bp, Homo sapiens
atgtgatgagctcggtaccgccaagcactcttttcttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435636 - DNA, 3038 bp, Homo sapiens
aaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435637 - DNA, 2763 bp, Homo sapiens
aaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatattttactcccgggggtttacccaacaaaaaccgattttacaagagacacggccaagtgccagga

SEQ ID NO: 435638 - DNA, 979 bp, Homo sapiens
agcatgcatcctagagagaatttggctagagtaaggagttttcttcatgaataattgatttttggatttttgtctttgcacaggggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435639 - DNA, 926 bp, Homo sapiens
atggcccacgtgtatccagcgtcgcagactgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435640 - DNA, 970 bp, Homo sapiens
taagcgaagtatcactagcacccccttcgttacccttgaacaggattccaactggattctgatccaacaccgggtactgcaattgtctacaaagatatgccagagggaattatgcataatatagaagagcctctaaagtgatccgggaagcattcttccatgataattatcagtggcttacctgagacataacagagaataacacaggtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435641 - DNA, 1082 bp, Homo sapiens
gcagtttcttttgaaaaactaggaatgcacacacatcatttcgtgcattaggcttaagttcttcactttccttgggaagcagaagcatattccaagttacttgtactctgtgctcaatattgcaatttgacagcttggaaaagaaacaaattactgaattctctagggcctttggttttcctaattttgatttatgttctgagaacctattgagtcaaatgccctctgacaccacatgtctcgtttatttggtacagttaattgctgttgaaaatgtttacagccaagggcaggtatttgtggcacattacccataggaatgcggtagagtggcagggaggccaggaaggatcaacatgcgttggctctgtgtgcaagagtgcacagaggtcatttgtggacttggagtaaactgaccatttggagaaactcctctggaaaattctgattctgattttgttctgtttccattgcagagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435642 - DNA, 2023 bp, Homo sapiens
  misc_feature (1967)..(1967): n is a, c, g, or t
  misc_feature (1985)..(1985): n is a, c, g, or t
  misc_feature (2018)..(2018): n is a, c, g, or t
aaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggacgaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgagggttccaagcgttccctgaccaacctggaccaanttggcgttccggggcctngatggtccgtggtttccccccggggttttcaantccaa

SEQ ID NO: 435643 - DNA, 1447 bp, Homo sapiens
aaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgaggagagtagttatggctcaccttttactccggctaagagacctaagaggaaagttgcccctaagaggagacaggaaagaccagttgctcctccaaagaaaagaagaagaaaaatacataggatggatcattatgctgcggaaactcgtcaggacaaaatgacaaatcctctgagggaaatcgacaaaattgtggggcaattaatggatggactctgtacagggtccgatgcagaaaaggggaaggaggaaatcagagttccccaaatggggttttatcagatctcagggaagttggtatcatgcttcttatcaaggccaacccataggattacggtagggaggcaaaatcccaggcttttcagaagtggatccttaggaaaggaaagtagggggaaggtgcctaagtcactc

SEQ ID NO: 435644 - DNA, 989 bp, Homo sapiens
  misc_feature (23)..(23): n is a, c, g, or t
  misc_feature (28)..(28): n is a, c, g, or t
  misc_feature (30)..(30): n is a, c, g, or t
gcgaatccagctgcagctcagtnatttngngtccccgaacgagctaattgagcattctgtaaccataggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 435645 - DNA, 2674 bp, Homo sapiens
aaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggacgaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagtccagaggatgaatcacaaagggtagaagaaagcatgaagacgcacaccgctagggtgcgatggacactggacatcggagcaccggacaacgagcccgcaagagacagcaagacgtgacacggacaccggtcacacgcaagatatgcacgcacagatatcagtgacgagattcgagctgtatgtgcatatgcagtacagttacttcagctgcttgtatatgtgtatattatcttggtgtca

SEQ ID NO: 435646 - DNA, 2328 bp, Homo sapiens
aaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggacgaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggcccaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaaggtaaggggtggttgcaaaataatcagataaggtttttctcgttttcgaaaatcgaaaaggcttcttatttacattatagtgtaagcacaatattgtttaaaattagaatttgtatttcaaagtgactttcatacctatctggcaaaggatattggtttattccatgtacacaagatgccagctgtgtaataaaaaaattccaatagcttttctcccccctcaatagcttttaagccctctgaaaagtacacaatccattttgtatctgatgagtcataagacactgtggggcactcctataaagggaatgatagtcacaatgataaataatagcagctggtgcctatcctgaaggtatctacctcgagagtcagtgtatatatagatatatatatattgtgatagggagagattcaccgaaggaatcaaatcagaactccctcctcatatgaaggatcatctcaagccctaactcttactttacgtacaatgataacgagcacgtattagtgaactttcgcaagcttatgatatgacc

SEQ ID NO: 435647 - DNA, 1074 bp, Homo sapiens
  misc_feature (1016)..(1016): n is a, c, g, or t
aaagcagtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaatnttgtcgatttccctcagaggatttgtcatctcagggcgaaagggccatatttggtcga

SEQ ID NO: 435648 - DNA, 2901 bp, Homo sapiens
cagcttgcagtcaagaccccctaccggtgacacttgcgctcttcggggaggtaaacagcatttcctctcagctctgggttggaaaaagccgcagcagctgatgggcccgggaacccgaggccccgccccctaggtggtcctagcctttgcgcgtgcgcggcgtgtctgcgtgggcgcatgcgcataacggccgccatcttaacagcgcgttcccgttggcgtctgaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacggatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtc

SEQ ID NO: 435649 - DNA, 3288 bp, Homo sapiens
cagcttgcagtcaagaccccctaccggtgacacttgcgctcttcggggaggtaaacagcatttcctctcagctctgggttggaaaaagccgcagcagctgatgggcccgggaacccgaggccccgccccctaggtggtcctagcctttgcgcgtgcgcggcgtgtctgcgtgggcgcatgcgcataacggccgccatcttaacagcgcgttcccgttggcgtctgaggtaagtttttgtttctgggcggcgttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggtctgtcctcaggggtcgaggcggctgcgctggggcctcggcccgggaggaggcggggggcacggcctttccattttccctgctcccctctgcagaagcctcatagggcccggcgcggcggctcacgcctgtcattcccagcgctttgggcggattgggtaggaggattacttgaggccaggagttcaagaccaggcagggcaacatagggagaccccccccccaaccatctctaatggaaaaaaaaaaaaaagtctccacatccagcgttgtgccttttctctataaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacggatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtc

SEQ ID NO: 435650 - DNA, 3334 bp, Homo sapiens
cagcttgcagtcaagaccccctaccggtgacacttgcgctcttcggggaggtaaacagcatttcctctcagctctgggttggaaaaagccgcagcagctgatgggcccgggaacccgaggccccgccccctaggtggtcctagcctttgcgcgtgcgcggcgtgtctgcgtgggcgcatgcgcataacggccgccatcttaacagcgcgttcccgttggcgtctgaggtaagtttttgtttctgggcggcgttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggaacagcatctctgccttcctgttcacggtgaccttcgcttggtgtcctcctggcctcagcaacctgacaattctgtcgtgtcccggcaggagtgcagtggtgagatcacggttcactgcagcattgacctccctgggctcaggtgttgctcccacctcagtcttctgaatagcttggagtatagagagatggctaatgaatggcgcttgatgacagatgagtaatgcctgttgctgaaagattgacggtatgaggcaagactcccactactacttaatcaagaggaattgagattgacttacccataagttcagacagtgtctcgaagagactttgggaacaagatattcaggcacatttcactgttagactcacaggatgctggccattggtctttccctttgtgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtc

SEQ ID NO: 435651 - DNA, 4140 bp, Homo sapiens
cagcttgcagtcaagaccccctaccggtgacacttgcgctcttcggggaggtaaacagcatttcctctcagctctgggttggaaaaagccgcagcagctgatgggcccgggaacccgaggccccgccccctaggtggtcctagcctttgcgcgtgcgcggcgtgtctgcgtgggcgcatgcgcataacggccgccatcttaacagcgcgttcccgttggcgtctgaggtaagtttttgtttctgggcggcgttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggaacagcatctctgccttcctgttcacggtgaccttcgcttggtgtcctcctggcctcagcaacctgacaattctgtcgtgtcccggcaggagtgcagtggtgagatcacggttcactgcagcattgacctccctgggctcaggtgttgctcccacctcagtcttctgaatagcttggagtatagagagatggctaatgaatggcgcttgatgacagatgagtaatgcctgttgctgaaagattgacggtatgaggcaagactcccactactacttaatcaagaggaattgagattgacttacccataagttcagacagtgtctcgaagagactttgggaacaagatattcaggcacatttcactgttagactcacaggatgctggccattggtctttccctttgtgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctgaagatcctgagttatctcaattgttcacggttacagatggaactctttattattgaggagttccactctttcccccatttgtcactactacacttccctagtctttaaaacaattttaggctgggtgcagtggctcattcctgtaatcccagcactttgaaaggccgaagcgagtggatcatttgaggtcaggagttcgagaccagcctggccaacgtggtgaaaccccatctctactaaaaatacaaaaattagccaggcatggtggtacgtgcctgtaatcccagctactcgagaggttgaggcagaattgcttgaacccgggaggcggaagctgcagtgagctcagatcgcgccactgcactccagcctggatgatatggtaagaccatctcaaaaaaagaaaaaaaaattaaaatatcctcagagggttttttaatgaaaaacttagttataaggaattgaggaacatttaggggtacaaattttcacttattgcacacaagaaaattggtactggccaggcatgctggctcacaccttaattccagcaatttgggaggccaaggcagaaggatcacttgagcccaggagttcaagaccagcctgggcaatatagtgaaacctcatcttgacaaagaataaataagattaactgggtgtactggtttgtgcctgtagtcccagctatttaggaggctggggcaggaggattgcttgagcctggtcagggaggcagaggttgcagtgagccctgatcgtgccactacactctagcctgggcaacaggatgagaccctgtct

SEQ ID NO: 435652 - DNA, 3077 bp, Homo sapiens
cagcttgcagtcaagaccccctaccggtgacacttgcgctcttcggggaggtaaacagcatttcctctcagctctgggttggaaaaagccgcagcagctgatgggcccgggaacccgaggccccgccccctaggtggtcctagcctttgcgcgtgcgcggcgtgtctgcgtgggcgcatgcgcataacggccgccatcttaacagcgcgttcccgttggcgtctgaggtaagtttttgtttctgggcggcgttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacggatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtc

SEQ ID NO: 435653 - DNA, 2868 bp, Homo sapiens
aatgattgtactatcccactgtttactaattcagtctgactgtcatccatgctgatatgctttcattttgctgtgatagggagagaatgcacatgtgcttctcggaatttgtgctgtcactggagcatttatttgagtgtctataatgtattcagggttgtgctaaaacctgtcagtagagaacaataagaagaagtcacaatctagttgtgctgagatatattcagttaggtgaaagaggtgctcttcaagccatatgactagatgagatcaccggtgaatatgtacagacaggggagaagaaagtgaggaccatcaagtgataggagaccaaagagtcttgtcaaggcatgccaagacaaggtccctcattctccagtcaacatagtggagaacgtacttgcctgacgccagcatgtgtgtgatggtttaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtc

SEQ ID NO: 435654 - DNA, 3105 bp, Homo sapiens
tgcagggtttgggcaacccaggcctgttgagttaacctttccgtacatcatttcatgacgatctcatggtcacgttggagaataagaagaacctcaggagtttaggtttgtgagtcagagtaacctgtattcatatcctggctcacactttctaattggtgatgttgggttaattagtgtctgagcttaggtttcctcaactaatatgatagtaacaaaaactgctttgataattatatgaacttatcctaccactgtttctggcacatgggtactaggtaaacgggatttgttattatttatgtccacgtggcataatactctagtggcactcacatgaacaacttcatcttctgcagagagatggctaatgaatggcgcttgatgacagatgagtaatgcctgttgctgaaagattgacggtatgaggcaagactcccactactacttaatcaagaggaattgagattgacttacccataagttcagacagtgtctcgaagagactttgggaacaagatattcaggcacatttcactgttagactcacaggatgctggccattggtctttccctttgtgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtc

SEQ ID NO: 435655 - DNA, 3465 bp, Homo sapiens
cagcttgcagtcaagaccccctaccggtgacacttgcgctcttcggggaggtaaacagcatttcctctcagctctgggttggaaaaagccgcagcagctgatgggcccgggaacccgaggccccgccccctaggtggtcctagcctttgcgcgtgcgcggcgtgtctgcgtgggcgcatgcgcataacggccgccatcttaacagcgcgttcccgttggcgtctgaggtaagtttttgtttctgggcggcgttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggtctgtcctcaggggtcgaggcggctgcgctggggcctcggcccgggaggaggcggggggcacggcctttccattttccctgctcccctctgcagaagcctcatagggcccggcgcggcggctcacgcctgtcattcccagcgctttgggcggattgggtaggaggattacttgaggccaggagttcaagaccaggcagggcaacatagggagaccccccccccaaccatctctaatggaaaaaaaaaaaaaagtctccacatccagcgttgtgccttttctctataaggaacagcatctctgccttcctgttcacggtgaccttcgcttggtgtcctcctggcctcagcaacctgacaattctgtcgtgtcccggcaggagtgcagtggtgagatcacggttcactgcagcattgacctccctgggctcaggtgttgctcccacctcagtcttctgaatagcttggagtatagagagatggctaatgaatggcgcttgatgacagatgagtaatgcctgttgctgaaagattgacggatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatgaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtc

SEQ ID NO: 435656 - DNA, 2276 bp, Homo sapiens
cgccatctcccatagctgtcgcctgcagctgagaaagggttgctgtcccagcaggccaggtccagggctgggtataagtaagcaagaagagggcctgggagaagagtctgacgagcaaggggaaggtagccaaggatggagtgaaatacagggtgacctgtgtttttcccctggctcctttggaaattatgggaaaaaatcaaataccaaggaagaaaaatctataatgaaattagatgtggatttctttttatgtattcagcttgggggcttatgatacttctagtacccaaagagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacatgaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcattgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgttttcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttcaaaaaagcaatgtggacagttttcacccagcttcccttacagctgtgagcggccaaatatgttcacatccctagcccatgcaaagtaggcagaagtcactggatacagctgctaaggaagctcatggaaatgggaatatctcatctggtgtttttttcttaactatttgccctttgtcttgtcccttatttcctagaaaatatatacaccaagaggaggacagagaaaggatactaaatgaaacaacaggggagatacaatattatctggttgcactaatcctgtgctgcttatctctggatttcatgttacatgagaaaaattaactgccatgtggtttaaaccactcttgtgggaagttcctctttcagctgatttcagtcccaactgttacatctaataaatggtcaagttttaggaatcgttcaagtatggttgaaaaa

SEQ ID NO: 435657 - DNA, 3105 bp, Homo sapiens
cagcttgcagtcaagaccccctaccggtgacacttgcgctcttcggggaggtaaacagcatttcctctcagctctgggttggaaaaagccgcagcagctgatgggcccgggaacccgaggccccgccccctaggtggtcctagcctttgcgcgtgcgcggcgtgtctgcgtgggcgcatgcgcataacggccgccatcttaacagcgcgttcccgttggcgtctgaggtaagtttttgtttctgggcggcgttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggtctgtcctcaggggtcgaggcggctgcgctggggcctcggcccgggaggaggcggggggcacggcctttccattttccctgctcccctctgcagaagcctcatagggcccggcgcggcggctcacgcctgtcattcccagcgctttgggcggattgggtaggaggattacttgaggccaggagttcaagaccaggcagggcaacatagggagaccccccccccaaccatctctaatggaaaaaaaaaaaaaagtctccacatccagcgttgtgccttttctctataaggaacagcatctctgccttcctgttcacggtgaccttcgcttggtgtcctcctggcctcagcaacctgacaattctgtcgtgtcccgggctgggtataagtaagcaagaagagggcctgggagaagagtctgacgagcaaggggaaggtagccaaggatggagtgaaatacagggtgacctgtgtttttcccctggctcctttggaaattatgggaaaaaatcaaataccaaggaagaaaaatctataatgaaattagatgtggatttctttttatgtattcagcttgggggcttatgatacttctagtacccaaagagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacatgaatcctcatggaagagaattcctgtgaataaggtgaaagtgaaaaagcctctagtcaccacttactcccttttcaacaggcagaaaatcaacctggtgagcactccctggagtgtaaccattgtgggaaattcagaaagaacactcgctttatttgtacaagatattgcaagggagagaaatgctataaatatataaagtatagcaaagtcttcaaccatccctcaactcttaggagtcatgtgagcattcacattggagagaaaactcttgaatttactgattgtagaaaagctttcaatcaagagtcatccctcaggaaacacttaagaactcccacaggacagaagtttcaggagtatgagcaatgtgatatgtccttcagcctacactcttcctgctcagtacgtgagcaaatacctactggagagaaaggtgatgaatgcagtgactatggcaaaatatctccccttagtgtccacacaaaaactggtagtgtggaggagggtttggaatgtaatgaacatgagaaaactttcactgaccctttgtcccttcagaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcattgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgttttcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttc

SEQ ID NO: 435658 - DNA, 2580 bp, Homo sapiens
tgcagggtttgggcaacccaggcctgttgagttaacctttccgtacatcatttcatgacgatctcatggtcacgttggagaataagaagaacctcaggagtttaggtttgtgagtcagagtaacctgtattcatatcctggctcacactttctaattggtgatgttgggttaattagtgtctgagcttaggtttcctcaactaatatgatagtaacaaaaactgctttgataattatatgaacttatcctaccactgtttctggcacatgggtactaggtaaacgggatttgttattatttatgtccacgtggcataatactctagtggcactcacatgaacaacttcatcttctgcagagagatggctaatgaatggcgcttgatgacagatgagtaatgcctgttgctgaaagattgacggtatgaggcaagactcccactactacttaatcaagaggaattgagattgacttacccataagttcagacagtgtctcgaagagactttgggaacaagatattcaggcacatttcactgttagactcacaggatgctggccattggtctttccctttgtgatcatctttctcaagatgttttctgtcttcatgagtcaaaatttgaagaggaaaggatggtggctgggtggttgacaaattactctcagttgctttgattagaaagtttggctttgctgagatacgtagttggaaaagagagaagcattttcagtttcttcagtgtactagatggctgactgggaagattccagggtcccaacaggcttcagagttgcgaaggctctagagggctgggtataagtaagcaagaagagggcctgggagaagagtctgacgagcaaggggaaggtagccaaggatggagtgaaatacagggtgacctgtgtttttcccctggctcctttggaaattatgggaaaaaatcaaataccaaggaagaaaaatctataatgaaattagatgtggatttctttttatgtattcagcttgggggcttatgatacttctagtacccaaagagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacatgaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcattgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgttttcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttc

SEQ ID NO: 435659 - DNA, 2345 bp, Homo sapiens
cagcttgcagtcaagaccccctaccggtgacacttgcgctcttcggggaggtaaacagcatttcctctcagctctgggttggaaaaagccgcagcagctgatgggcccgggaacccgaggccccgccccctaggtggtcctagcctttgcgcgtgcgcggcgtgtctgcgtgggcgcatgcgcataacggccgccatcttaacagcgcgttcccgttggcgtctgaggtaagtttttgtttctgggcggcgttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggaacagcatctctgccttcctgttcacggtgaccttcgcttggtgtcctcctggcctcagcaacctgacaattctgtcgtgtcccgatcatctttctcaagatgttttctgtcttcatgagtcaaaatttgaagaggaaaggatggtggctgggtggttgacaaattactctcagttgctttgattagaaagtttggctttgctgagatacgtagttggaaaagagagaagcattttcagtttcttcagtgtactagatggctgactgggaagattccagggtcccaacaggcttcagagttgcgaaggctctagagggctgggtataagtaagcaagaagagggcctgggagaagagtctgacgagcaaggggaaggtagccaaggatggagtgaaatacaggagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacatgaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcattgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgttttcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttc

SEQ ID NO: 435660 - DNA, 1998 bp, Homo sapiens
gaggaaaaagagaccttgtgcgaggcaaaactggagatgcaaagtaaaaagatgaggagtgctgaaaggggtgtcttgtacttagaatcctagggatccagctagggcggcagtcgtcagaggttgtaatggggactgatgaggtaattgcgtcgagggggaggttcgattttcatggtgtatgagaaaacgtcgagtatctacaagcaacctttcactgttattttcagggctgggtataagtaagcaagaagagggcctgggagaagagtctgacgagcaaggggaaggtagccaaggatggagtgaaatacagggtgacctgtgtttttcccctggctcctttggaaattatgggaaaaaatcaaataccaaggaagaaaaatctataatgaaattagatgtggatttctttttatgtattcagcttgggggcttatgatacttctagtacccaaagagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacatgaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcattgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgttttcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttc

SEQ ID NO: 435661 - DNA, 1885 bp, Homo sapiens
aatctgtaaacctaggttaacacttgctggctcacagagaataaccacaagtaaacatctatgtaaatatgattttagagttaagtatttagtacataattcattcattcttcactcagtattagaaaaactgtattaaagaagccctttgctgggaaggaatagagccttggacagaggagtgagcttattcaactcgaaaaagctaatagggcaaaagtcatacgcacctactgaaaatggtacacatgtcagtcatgatcatgtgcttcctatatatggcagaatcctcatggaagagaattcctgtgaataaggtgaaagtgaaaaagcctctagtcaccacttactcccttttcaacaggcagaaaatcaacctggtgagcactccctggagtgtaaccattgtgggaaattcagaaagaacactcgctttatttgtacaagatattgcaagggagagaaatgctataaatatataaagtatagcaaagtcttcaaccatccctcaactcttaggagtcatgtgagcattcacattggagagaaaactcttgaatttactgattgtagaaaagctttcaatcaagagtcatccctcaggaaacacttaagaactcccacaggacagaagtttcaggagtatgagcaatgtgatatgtccttcagcctacactcttcctgctcagtacgtgagcaaatacctactggagagaaaggtgatgaatgcagtgactatggcaaaatatctccccttagtgtccacacaaaaactggtagtgtggaggagggtttggaatgtaatgaacatgagaaaactttcactgaccctttgtcccttcagaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcattgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgttttcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttc

SEQ ID NO: 435662 - DNA, 3060 bp, Homo sapiens
tgcagggtttgggcaacccaggcctgttgagttaacctttccgtacatcatttcatgacgatctcatggtcacgttggagaataagaagaacctcaggagtttaggtttgtgagtcagagtaacctgtattcatatcctggctcacactttctaattggtgatgttgggttaattagtgtctgagcttaggtttcctcaactaatatgatagtaacaaaaactgctttgataattatatgaacttatcctaccactgtttctggcacatgggtactaggtaaacgggatttgttattatttatgtccacgtggcataatactctagtggcactcacatgaacaacttcatcttctgcagagagatggctaatgaatggcgcttgatgacagatgagtaatgcctgttgctgaaagattgacggtatgaggcaagactcccactactacttaatcaagaggaattgagattgacttacccataagttcagacagtgtctcgaagagactttgggaacaagatattcaggcacatttcactgttagactcacaggatgctggccattggtctttccctttgtgatcatctttctcaagatgttttctgtcttcatgagtcaaaatttgaagaggaaaggatggtggctgggtggttgacaaattactctcagttgctttgattagaaagtttggctttgctgagatacgtagttggaaaagagagaagcattttcagtttcttcagtgtactagatggctgactgggaagattccagggtcccaacaggcttcagagttgcgaaggctctagagggctgggtataagtaagcaagaagagggcctgggagaagagtctgacgagcaaggggaaggtagccaaggatggagtgaaatacagggtgacctgtgtttttcccctggctcctttggaaattatgggaaaaaatcaaataccaaggaagaaaaatctataatgaaattagatgtggatttctttttatgtattcagcttgggggcttatgatacttctagtacccaaagagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacatggcagaaaatcaacctggtgagcactccctggagtgtaaccattgtgggaaattcagaaagaacactcgctttatttgtacaagatattgcaagggagagaaatgctataaatatataaagtatagcaaagtcttcaaccatccctcaactcttaggagtcatgtgagcattcacattggagagaaaactcttgaatttactgattgtagaaaagctttcaatcaagagtcatccctcaggaaacacttaagaactcccacaggacagaagtttcaggagtatgagcaatgtgatatgtccttcagcctacactcttcctgctcagtacgtgagcaaatacctactggagagaaaggtgatgaatgcagtgactatggcaaaatatctccccttagtgtccacacaaaaactggtagtgtggaggagggtttggaatgtaatgaacatgagaaaactttcactgaccctttgtcccttcagaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcattgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgttttcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttc

SEQ ID NO: 435663 - DNA, 640 bp, Homo sapiens
ctgctcaaaaaaatctatacaaagatgtgatgctggagaactttaggaacctggcctcagtaggtaaggctggcctcatttcttcatttgtttatgtagcaaatagttcttaagcacatattatgttccagaatctgtggaaagaatagcaatacagtggttaaccccaaaatgaatggtccctgcccttgagggggcagtccagtggcttcccatgaaaatgcactgatttcattttctctatcactaatagcttaaggtaatttgcaatctgtgtctcatcttgtgtataggtttcaagggtcacttccatatagggcgtggaccatgctttttggttcttgtgaaagaaagagctcggctctgattgttttgttgttcctaaagctgcacttgactattttaataatcctttagttaaagccaaagtatggcaatcagttttgtggaatatttaattctcacacatttctcccacatccttgctttctgcgtgagcagggtatcagctctgcagacacagtctgatctccaaggtggatcaagaacagctgaagacagatgaaagaggaattttacaaggtgactgtgcaggtgagccttgggcagaacagggtgcagccttggccagtgagggtta

SEQ ID NO: 435664 - DNA, 715 bp, Homo sapiens
gaattggggcaaattttaaaaatattttagtaatatacataacatgctttttaaaaataacttttccacaatggcaacaaaataatgtggaaagagcgacatattgcatgcttttgcaaatctctttaatgtcttaagagcttaatagatgacagctgaattctcatacttgtttctacattttttgccattagttgctttgattagaaagtttggctttgctgagatacgtagttggaaaagagagaagcattttcaggtaattttggattttctttgatattacaccaaaactcaagaaatggtagtttctgaaagattagttgcaatatggaatgaaatcctgttaaggaattgtttctattctgttacattaaaattcatttgtttgtcttgcactatttttttcttttccttttatttatttatttatttatttttgagacagagtctcgctctgtcgcccaggctggaatgcagtggcgcaatctcggctcactgcaagctctgcctcccaggttcacaccattctcctgcctcagtctcccgagtagctggggctacaggctcccgccaccgcgcccggctaattttttgtatttttaatagagacggggtttcactgtgttagccaagatggtctcaatctcctgacctcgtgatccacctgcctcggcctccgaaagtgttgggattacaggcgtgaggcactgcg

SEQ ID NO: 435665 - DNA, 328 bp, Homo sapiens
gaaaaatcatgggtatcttctttcttagcaaagcttattatttaggtgtatctgcattcttggctctctgaggtatttttaaaaggtatgattttgtagttatgtggcttgtgttttaagagagaaggatcaacccttggaagttctacattctaatatgaatgtatgagaaaatgtatcttggtttttgttttgttggatttttgagacaaggtcttactctgttgcccaggcaggagtgcagtggtgagatcacggttcactgcagcattgacctccctgggctcaggtgttgctcccacctcagtcttctgaatagcttggagta

SEQ ID NO: 435666 - DNA, 517 bp, Homo sapiens
aagtgataggagaccaaagagtcttgtcaaggcatgccaagacaaggtccctcattctccagtcaacatagtggagaacgtacttgcctgacgccagcatgtgtgtgatggtttaggactcagtgacctttgaggatgtggctgtggacttcacccaggaggagtggactttgctggatcaaactcagagaaacttatacagagatgtgatgctggagaactataagaatctagttgcagtaggtaaggctggtaccattcttttcatttagtttttttctggaacaaatgtgtcttaagtaactatgttctagactctgcttgttaatgggctgcattggtaaacaggcgaaacattgtttccatctcatagaccttactgccttgtgatttttctgatgaaattgaagatctgttcattgttctagctttattttctccatggataaaagacttagagcttcttgaatatgtgtatgagcttaagcctgggtttcatgggaaggattgctagtcc

SEQ ID NO: 435667 - DNA, 801 bp, Homo sapiens
agaggaagattggaaattccttaaaatggaaaagcagcacaataaccttgagacatttgagactagtgtttttcacccaaaaataatctgtctcttggagagactatggatcatgagtttgacaaacactctaaacatccctcagaatatatttgtttacatatttccttcaacattcccatatgtatctcagatgtttttgataaataattcactcttgggccgttatcagctaagctctatttagaagccctctgaaagtaaagaatataacagaacttcctgcagtcactttgttccacttgaaaacactcaggtctgaaccatgccttgcaatgaaaatggcaggaacaaacagtttcaattatactaacttattttccatgtgtaacagaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtga

SEQ ID NO: 435668 - DNA, 2490 bp, Homo sapiens
actaagtgagaaattagaagtaattgttttataattaagttgctgggttttttttttaacaccttctaattcatcactttgtagggttatgcaagagtttctgaataaccattcttacatgtttatattttataaaaaccggctgcaagaaagattcagaaagaatacttagtaagtcatcatatgaaaaaccaacaaaaccatagagtgcagattttttcctaactataagtcacctcatagttgtccaaagccatgataatgatatctcttacaaattgacttctgtaacccccctagaaataacccttttccttatttgattttagtcatcaaacatagtatgatatgggaaaagtcagccatttaccagaaattatcttattttgattttaaaaactcatttctatatgtagttattgtaatgtctatttttttagacttaaagatttatagaagactatagttatctgatttgttattttgcatttttcattctgtaaatctttgcttatggcacattgtgctctctgttttccatggttttattcatttatctcctcctattttgaggggacaacatgggtagttaaatctttgtcaatagtattggagataacactaactgctattatcataacatcttcatttttactgcatgccaaaaccaatgcctgccaaacaaaatcttagacatcccaatataatatgttagttatatttctattcacatcattattgaaaatacccagctcagtgcctggcttaataaatgtttaattcccttacctactcttgctctatttttttatttgaaatggagatgagcaaaataacacattcatggctgaagcaattttttggacatttcttgttaccaaaagatctataatcaggacattgtttatgtaagttggacaaaaaaaattcttcccctttatgtccacccttcctatgattgcaagacaaaatttccctcctttacctcatccctataacatgggaggctgagaaaaatgaggggagatggaaccagatacaaggagatccaataagagaagcttatttaaatattgtgaaataaaggaagaaccaaagcatttttttaagtggggaatccttttgaacagttattatttatccatattattaacaacatcttttctgacaaaatccatcagatgaagtgtaaatggataatcttttaatggatctaaacctagaaagtttcacttactgttcatgtccgtgttccagaattgtgaaatggtgtgtggttttgctttccaagttcttctctgcctcctcttaattctctaattccatgtcttacagaagaatgagaaatttctttcttacttgagtatcatgctctaaaaaacttggcttcagtcacagaaacgctggctctcctgtgcttatattgaagccaactgcctttaattcttgggccctcttatatttttaaggtgcaaaatttgaagtctcagtcaccagacacaggttctatacaattaatgatgagctggagaagtaatatgtagctaatttttcaaaagcattgaatatactttccggaaagaaaacagaaattaaatattgccacatcttgccagaatcccatctgacaccttaactttgtcaggtttcctacaacttgctaatcaagttttatacattctaaatctccccagtttctttggggctggaagatgcaacttccatttaatagaaactttgaaatcttggggtaagggagcagtggggggactagggagaaggataagaaatagaattattgaaaagcccccaccagggaccttcctggccagaatatgcagagtaattcctgctggcttcacctttgaaagtccctcgaaactatgcagatgaaactgagtctgtttttgatattgtcagatgtattctaccttggaagtcccaacacctaaactggaattcttgtatttacatctcctccactgtcccccacaccacccctcaattcctgctgcccctgctaatgttaagcatttttctcttgttatcatcaggttcacattaaaaacagatacttacaaactgacttgaagcacagatacttttacgaatgtgataaaatattttcttaagaaaaggaaagaggatgtgggtcaaataaaacaccgcatggatgttgattggtgaatactggtgtaagaaaagggagctcaggaatttttattactgtatttgtaaatgagtttgaaggaatttgtaaatgccactggtacatttttaaggtgacacatttgctccttataaagttattaaaaattacagggtaagcttaaatgacgtttgccagtagttttactttatataatcaatattgatattgttgctgaactatgtaactttatgatgcatttttcagtcccttttcagagcaaatgcttttgcaatggtagtaatgtttagtttaaattgacttaataaattattacctga

SEQ ID NO: 435669 - DNA, 978 bp, Homo sapiens
  misc_feature (937)..(937): n is a, c, g, or t
actaagtgagaaattagaagtaattgttttataattaagttgctgggttttttttttaacaccttctaattcatcactttgtagggttatgcaagagtttctgaataaccattcttacatgtttatattttataaaaaccggctgcaagaaagattcagaaagaatacttagtaagtcatcatatgaaaaaccaacaaaaccatagagtgcagattttttcctaactataagtcacctcatagttgtccaaagccatgataatgatatctcttacaaattgacttctgtaacccccctagaaataacccttttccttatttgattttagtcatcaaacatagtatgatatgggaaaagtcagccatttaccagaaattatcttattttgattttaaaaactcatttctatatgtagttattgtaatgtctatttttttagacttaaagatttatagaagactatagttatctgatttgttattttgcatttttcattctgtaaatctttgcttatggcacattgtgctctctgttttccatggttttattcatttatctcctcctattttgaggggacaacatgggtagttaaatctttgtcaatagtattggagataacactaactgctattatcataacatcttcatttttactgcatgccaaaaccaatgcctgccaaacaaaatcttagacatcccaatataatatgttagttatatttctattcacatcattattgaaaatacccagctcagtgcctggcttaataaatgtttaattcccttacctactcttgctctatttttttatttgaaatggagatgagcaaaataacacattcatggctgaagcaattttttggacatttcttgttaccaaaagatctataatcaggatgatcctgagctgttcaaacaagctggtatataaacagncattgaaactcttttgcagagctgggaatttaaaagggaag

SEQ ID NO: 435670 - DNA, 349 bp, Homo sapiens
agctcaggaatttttattactgtatttgtaaatgagtttgaaggaatttgtaaatgccactggtacatttttaaggtgacacatttgctccttataaagttattaaaaattacagggtaagcttaaatgacgtttgccagtagttttactttatataatcaatattgatattgttgctgaactatgtaactttatgatgcatttttcagtcccttttcagagcaaatgcttttgcaatggtagtaatgtttagtttaaattgacttaataaattattacctgagcaatggtttttggagggtctttatatatgtatgtgaaacatgcattacatgaaaaatttaacttg

SEQ ID NO: 435671 - DNA, 1531 bp, Homo sapiens
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggagagcccagacgggcttctgcatccattccctctttttgtttttaaaataaattgtatttttgaatcaaggaggataaa

SEQ ID NO: 435672 - DNA, 1399 bp, Homo sapiens
ggctgaattgggccagagaggtctcattggctgaattcctgcaccggctcgtcggaggcgggacccaaagtaggctaggcctacggaagctgggtcttcttgctgtgagccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggagagcccagacgggcttctgcatccattccctctttttgtttttaaaataaattgtatttttgaatcaaggaggataaa

SEQ ID NO: 435673 - DNA, 1920 bp, Homo sapiens
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggagagcccagacgggcttctgcatccattccctctttttgtttttaaaataaattgtatttttgaatcaaggaggataaaaaaaaaaaaaaaataaaataaaaaaaaaaaaaaaaaaactaaaaaaataaaaaaatcctttataatatacacctctcggtcatcccccctaatcccaattttccctttcattctgactgtttcccattacatggccgcgctattacaacacctgtggtgcaaaacacttggggtacccactctattttccctttggccatattccccttttactcgtcgcgggcaatcctgaaaggccctcgcatatgggcctttccaaaatttgcgaccctttaaggggaatgggaacttttatgggtaatcctttcgttaaattggtggcaaccttttgtttaaacccttcactcttaatcaatgagccgccttctgatatatcctttttaacctcc

SEQ ID NO: 435674 - DNA, 2462 bp, Homo sapiens
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggtgagcaaagagcccaggcccctagagtgcgcatgtgcaggctccgctgttagaatcacagcggttcaaatccggcatctggtcgctgagtggcctcaggcagtgaccacgctcccggacccaaccttcagcttgcccaaagcaataatctttcctaaagaagtgcttggctggggatggtggctcacgcttgtaatcccagtactttgggaggccaaggcagtctgggcaatatagtgaggctcccatctgtactaaaaataaaaaagttaggcgtggcgatgtgcacctgtagtcccagctactcgggggctgagccaggcggatagcttgagctcagggggccaaggctgcagtgagtcatgatcgcaccactgcacccaaacctggggagagagctagactcttgtctcaaaaaaaaaaaaaaaaaaaaaaaaaaagctccaaagtcacctctgtcaaagccacagtctgttccttccacagccacaagatggcgacatgagcctaagtcaagtcctgtccctcaacccacgcccctcgctggcttccccacctctctcaggatgaaagcccaagtcatcagggtggcacgtcaggccctgcacgatgtgccccgtcacctccctgccctcccgtcatttgccctgggtctcccccaccagaatgggagccaggagtcccagccaggcacaggaccgagcctggctctcggtcagcaggtgatgagctgggagcagctccttggccagaggcttacaggcaacaagcggccaggcagggtctggccccgggctgctgggctcacaaagtcacactagaccacagtgacgatctctgtaagcacaaagggactccgatgtgggtggggtgaggagagaggcagccccggcctgaccggccccccgccccgcccccaccccgcccccaggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggagagcccagacgggcttctgcatccattccctctttttgtttttaaaataaattgtatttttgaatcaaggaggataaa

SEQ ID NO: 435675 - DNA, 2851 bp, Homo sapiens
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggtgagcaaagagcccaggcccctagagtgcgcatgtgcaggctccgctgttagaatcacagcggttcaaatccggcatctggtcgctgagtggcctcaggcagtgaccacgctcccggacccaaccttcagcttgcccaaagcaataatctttcctaaagaagtgcttggctggggatggtggctcacgcttgtaatcccagtactttgggaggccaaggcagtctgggcaatatagtgaggctcccatctgtactaaaaataaaaaagttaggcgtggcgatgtgcacctgtagtcccagctactcgggggctgagccaggcggatagcttgagctcagggggccaaggctgcagtgagtcatgatcgcaccactgcacccaaacctggggagagagctagactcttgtctcaaaaaaaaaaaaaaaaaaaaaaaaaaagctccaaagtcacctctgtcaaagccacagtctgttccttccacagccacaagatggcgacatgagcctaagtcaagtcctgtccctcaacccacgcccctcgctggcttccccacctctctcaggatgaaagcccaagtcatcagggtggcacgtcaggccctgcacgatgtgccccgtcacctccctgccctcccgtcatttgccctgggtctcccccaccagaatgggagccaggagtcccagccaggcacaggaccgagcctggctctcggtcagcaggtgatgagctgggagcagctccttggccagaggcttacaggcaacaagcggccaggcagggtctggccccgggctgctgggctcacaaagtcacactagaccacagtgacgatctctgtaagcacaaagggactccgatgtgggtggggtgaggagagaggcagccccggcctgaccggccccccgccccgcccccaccccgcccccaggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggagagcccagacgggcttctgcatccattccctctttttgtttttaaaataaattgtatttttgaatcaaggaggataaaaaaaaaaaaaaaataaaataaaaaaaaaaaaaaaaaaactaaaaaaataaaaaaatcctttataatatacacctctcggtcatcccccctaatcccaattttccctttcattctgactgtttcccattacatggccgcgctattacaacacctgtggtgcaaaacacttggggtacccactctattttccctttggccatattccccttttactcgtcgcgggcaatcctgaaaggccctcgcatatgggcctttccaaaatttgcgaccctttaaggggaatgggaacttttatgggtaatcctttcgttaaattggtggcaaccttttgtttaaacccttcactcttaatcaatgagccgccttctgatatatcctttttaacctcc

SEQ ID NO: 435676 - DNA, 1880 bp, Homo sapiens
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggtgagcaaagagcccaggcccctagagtgcgcatgtgcaggctccgctgttagaatcacagcggttcaaatccggcatctggtcgctgagtggcctcaggcagtgaccacgctcccggacccaaccttcagcttgcccaaagcaataatctttcctaaagaagtgcttggctggggatggtggctcacgcttgtaatcccagtactttgggaggccaaggcagtctgggcaatatagtgaggctcccatctgtactaaaaataaaaaagttaggcgtggcgatgtgcacctgtagtcccagctactcgggggctgagccaggcggatagcttgagctcagggggccaaggctgcagtgagtcatgatcgcaccactgcacccaaacctggggagagagctagactcttgtctcaaaaaaaaaaaaaaaaaaaaaaaaaaagctccaaagtcacctctgtcaaagccacagtctgttccttccacagccacaagatggcgacatgagcctaagtcaagtcctgtccctcaacccacgcccctcgctggcttccccacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggagagcccagacgggcttctgcatccattccctctttttgtttttaaaataaattgtatttttgaatcaaggaggataaa

SEQ ID NO: 435677 - DNA, 1976 bp, Homo sapiens
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttgccacaagatggcgacatgagcctaagtcaagtcctgtccctcaacccacgcccctcgctggcttccccacctctctcaggatgaaagcccaagtcatcagggtggcacgtcaggccctgcacgatgtgccccgtcacctccctgccctcccgtcatttgccctgggtctcccccaccagaatgggagccaggagtcccagccaggcacaggaccgagcctggctctcggtcagcaggtgatgagctgggagcagctccttggccagaggcttacaggcaacaagcggccaggcagggtctggccccgggctgctgggctcacaaagtcacactagaccacagtgacgatctctgtaagcacaaagggactccgatgtgggtggggtgaggagagaggcagccccggcctgaccggccccccgccccgcccccaccccgcccccaggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggagagcccagacgggcttctgcatccattccctctttttgtttttaaaataaattgtatttttgaatcaaggaggataaa

SEQ ID NO: 435678 - DNA, 1318 bp, Homo sapiens
  misc_feature (1205)..(1205): n is a, c, g, or t
  misc_feature (1207)..(1207): n is a, c, g, or t
  misc_feature (1210)..(1210): n is a, c, g, or t
  misc_feature (1212)..(1213): n is a, c, g, or t
  misc_feature (1215)..(1215): n is a, c, g, or t
  misc_feature (1225)..(1225): n is a, c, g, or t
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggcctaaatgtgcacagcatgctcaagcaccagacgctggtcctgacgctgcccaccgtcgccttcctggaggacaagctgctctggcaggactcacgttacagaccccttggncnccntnnangctgattcantatggggggaggtgtattgaagtcctccagacaaccctcagatttgatgatttcctagtagaactcacagaaataaagagctgttatactgtg

SEQ ID NO: 435679 - DNA, 1274 bp, Homo sapiens
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggcctaaatgtgcacagcatgctcaagcaccagacgctggtcctgacgctgcccaccgtcgccttcctggaggacaagctgctctggcaggactcacgttacagaccccttcaagatggcgctggtggcttctgtgcgagtcccggcgcgcgtctgctccggcggggggccggtcccgggcgc

SEQ ID NO: 435680 - DNA, 2548 bp, Homo sapiens
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttgtgagggcacagggcagagcaggggcagggggccctgagctccgtactctgagggttcaacccccactccctggcctctcttacagaacacacgaggagatgccacagagcatcgtggaggccacctctaggcttaagaccttcaacttgatcccggctgttggtgagcaaagagcccaggcccctagagtgcgcatgtgcaggctccgctgttagaatcacagcggttcaaatccggcatctggtcgctgagtggcctcaggcagtgaccacgctcccggacccaaccttcagcttgcccaaagcaataatctttcctaaagaagtgcttggctggggatggtggctcacgcttgtaatcccagtactttgggaggccaaggcagtctgggcaatatagtgaggctcccatctgtactaaaaataaaaaagttaggcgtggcgatgtgcacctgtagtcccagctactcgggggctgagccaggcggatagcttgagctcagggggccaaggctgcagtgagtcatgatcgcaccactgcacccaaacctggggagagagctagactcttgtctcaaaaaaaaaaaaaaaaaaaaaaaaaaagctccaaagtcacctctgtcaaagccacagtctgttccttccacagccacaagatggcgacatgagcctaagtcaagtcctgtccctcaacccacgcccctcgctggcttccccacctctctcaggatgaaagcccaagtcatcagggtggcacgtcaggccctgcacgatgtgccccgtcacctccctgccctcccgtcatttgccctgggtctcccccaccagaatgggagccaggagtcccagccaggcacaggaccgagcctggctctcggtcagcaggtgatgagctgggagcagctccttggccagaggcttacaggcaacaagcggccaggcagggtctggccccgggctgctgggctcacaaagtcacactagaccacagtgacgatctctgtaagcacaaagggactccgatgtgggtggggtgaggagagaggcagccccggcctgaccggccccccgccccgcccccaccccgcccccaggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggagagcccagacgggcttctgcatccattccctctttttgtttttaaaataaattgtatttttgaatcaaggaggataaa

SEQ ID NO: 435681 - DNA, 1223 bp, Homo sapiens
gcggagatgctgcagcacgtcctgagtcgaggctgccgtggatctggtgtctgcgctctagcgatcagtggagggatcgtgtaattcgccttggctggcatcgagcgcaatcagcagtgcgcaccggaggagacccgggagccaggtggcggagcagatggtctctcgcgagtgctcggtgcttgtgcaataggtctctgactcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggagagcccagacgggcttctgcatccattccctctttttgtttttaaaataaattgtatttttgaatcaaggaggataaa

SEQ ID NO: 435682 - DNA, 2634 bp, Homo sapiens
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccaggtgaggccaggggctggaggcgtggtcgaaggatgaaatttgggggtgtccaggggtcgtctctcactttcgcccaacccttgcagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttgtgagggcacagggcagagcaggggcagggggccctgagctccgtactctgagggttcaacccccactccctggcctctcttacagaacacacgaggagatgccacagagcatcgtggaggccacctctaggcttaagaccttcaacttgatcccggctgttggtgagcaaagagcccaggcccctagagtgcgcatgtgcaggctccgctgttagaatcacagcggttcaaatccggcatctggtcgctgagtggcctcaggcagtgaccacgctcccggacccaaccttcagcttgcccaaagcaataatctttcctaaagaagtgcttggctggggatggtggctcacgcttgtaatcccagtactttgggaggccaaggcagtctgggcaatatagtgaggctcccatctgtactaaaaataaaaaagttaggcgtggcgatgtgcacctgtagtcccagctactcgggggctgagccaggcggatagcttgagctcagggggccaaggctgcagtgagtcatgatcgcaccactgcacccaaacctggggagagagctagactcttgtctcaaaaaaaaaaaaaaaaaaaaaaaaaaagctccaaagtcacctctgtcaaagccacagtctgttccttccacagccacaagatggcgacatgagcctaagtcaagtcctgtccctcaacccacgcccctcgctggcttccccacctctctcaggatgaaagcccaagtcatcagggtggcacgtcaggccctgcacgatgtgccccgtcacctccctgccctcccgtcatttgccctgggtctcccccaccagaatgggagccaggagtcccagccaggcacaggaccgagcctggctctcggtcagcaggtgatgagctgggagcagctccttggccagaggcttacaggcaacaagcggccaggcagggtctggccccgggctgctgggctcacaaagtcacactagaccacagtgacgatctctgtaagcacaaagggactccgatgtgggtggggtgaggagagaggcagccccggcctgaccggccccccgccccgcccccaccccgcccccaggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggagagcccagacgggcttctgcatccattccctctttttgtttttaaaataaattgtatttttgaatcaaggaggataaa

SEQ ID NO: 435683 - DNA, 1143 bp, Homo sapiens
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaacggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggagagcccagacgggcttctgcatccattccctctttttgtttttaaaataaattgtatttttgaatcaaggaggataaa

SEQ ID NO: 435684 - DNA, 620 bp, Homo sapiens
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggagagcccagacgggcttctgcatccattccctctttttgtttttaaaataaattgtatttttgaatcaaggaggataaa

SEQ ID NO: 435685 - DNA, 956 bp, Homo sapiens
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggtgagcgagggctgtaatggtgaactgagtggcagagggatgaagagcgggatttcaggagtcacgatgactttgggcttgtacccttgggaaagtgctgtatttctacagcctccgtttctccacctgtcaaaggggaatgatgacagtttcccctgctgtagcgctgtgtgagattgaagcctgagaggtgacatcatctaagggttagggagacagaattctggagcccgactgattaggttcaaatcctgccttcccctcttgtccctcagtgtccctattttgtcagcggtcgggaggttgctgtgatgaataaatgacttaa

SEQ ID NO: 435686 - DNA, 877 bp, Homo sapiens
  misc_feature (857)..(857): n is a, c, g, or t
ggctgaattgggccagagaggtctcattggctgaattcctgcaccggctcgtcggaggcgggacccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccaggggtcgtctctcactttcgcccaacccttgcagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgtgcccatggcccccgggccncaacaaatttattaatttac

SEQ ID NO: 435687 - DNA, 553 bp, Homo sapiens
gatgaaatttgggggtgtccaggggtcgtctctcactttcgcccaacccttgcagggcctgagttccctggcggaagaggcagcgcgtgcgaccgagaacccggagcaggtggcgagcgagggtaaggcaaccggggtggctccaggaggggcggcgacagagaggtctgacccttgaccctaacctctgacccccgcaatcgctccaggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggtgagcgagggctgtaatggtgaactgagtggcagagggatgaagagcgggatttcaggagtcacgatgactttgggcttgtacccttgggaaagtgctgtatttctacagcctccgtttctccacctgtcaaaggggaatgatgacagtttcccctgctgtagcgctgtgtgagattgaagcctgagaggtg

SEQ ID NO: 435688 - DNA, 860 bp, Homo sapiens
acgcgaggacgcaggaggaggagcccggagctgcagccaccggggagccaggcagcaaagcacctgctctgagtggccatggggaagcgatacttctgtgactactgcgaccgctccttccaggacaacctccacaaccgcaagaagcacctgaacgggctgcagcacctcaaggccaagaaggtctggtacgacatgttccgagatgcagctgccatcttgctggatgagcagaacaagcggccctgcaggaagtttctactgacaggccagtgcgactttggctccaactgcagattttcccacatgtcagagcgagacctgcaggagctgagcatccaggtggaggaggagaggcgagccagggagtggctactagatgctcctgagctccccgagggccatctggaggactggctggagaagagagccaagcggctgagctcagccccaagtagcagggctgaacccatcagaaccactgtcttccagtaccccgtgggctggccaccagttcaggagctgcctccatccctgcgggcacccccacctggggggtggcctctgcagcccagagtccagtggggctgagccccttgcccccgactgacccccacgtggtcacttttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcaccaca

SEQ ID NO: 435689 - DNA, 588 bp, Homo sapiens
tttaaaaaaaaatttagacaatgtttttttctgatttcaaaggcttgtgtgctcgtaaaacttttgagaaatataaaggagtaaaaaagtcacccataatggcaccactcagataggaccactgttaacattttgctgtgtcttccaggatttttttatgcatttatatattttatatatttttaaacaaaaatagtatcatgctatatacattattttataagctgctttttctccctatcacacagtatgtctttcctcatcagtgcatataaatctgccttaattcttacacaggccgcatggcattctctgctgtggacgtgcatatgtattgaatcagtcccccacaggtggacacgaaggttattcccattgtctcgcagctcaatgtctgcctgcaaccccgctatttccttgggctcagttcctagaggtgaggtcgctggctcaaacggtctgcctattttcgaggctctgccttccagaaaagtcatgcaggcagctgaccctccccacagccagggtggtgaggcaggtgggctgggggtggcataagcctgggctgtagtgcactcttattctccc

SEQ ID NO: 435690 - DNA, 975 bp, Homo sapiens
acgcgaggacgcaggaggaggagcccggagctgcagccaccggggagccagggtctctgtcacccaggctggagtgtagtggcgcaatctcagctggctggagccttgacctccttgggctcaagctatcctcccacctcagcctctcaaatagctgggactacaggcagcaaagcacctgctctgagtggccatggggaagcgatacttctgtgactactgcgaccgctccttccaggacaacctccacaaccgcaagaagcacctgaacgggctgcagcacctcaaggccaagaaggtctggtacgacatgttccgagatgcagctgccatcttgctggatgagcagaacaagcggccctgcaggaagtttctactgacaggccagtgcgactttggctccaactgcagattttcccacatgtcagagcgagacctgcaggagctgagcatccaggtggaggaggagaggcgagccagggagtggctactagatgctcctgagctccccgagggccatctggaggactggctggagaagagagccaagcggctgagctcagccccaagtagcagggctgaacccatcagaaccactgtcttccagtaccccgtgggctggccaccagttcaggagctgcctccatccctgcgggcacccccacctggggggtggcctctgcagcccagagtccagtggggctgagccccttgcccccgactgacccccacgtggtcacttttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcaccaca

SEQ ID NO: 435691 - DNA, 937 bp, Homo sapiens
acgcgaggacgcaggaggaggagcccggagctgcagccaccggggagccaggtaccttccgcgagacgtcgaggggcgagtcctagtctcttttctccgcactggaagacttgaacacttccttctctgcagcaaagcacctgctctgagtggccatggggaagcgatacttctgtgactactgcgaccgctccttccaggacaacctccacaaccgcaagaagcacctgaacgggctgcagcacctcaaggccaagaaggtctggtacgacatgttccgagatgcagctgccatcttgctggatgagcagaacaagcggccctgcaggaagtttctactgacaggccagtgcgactttggctccaactgcagattttcccacatgtcagagcgagacctgcaggagctgagcatccaggtggaggaggagaggcgagccagggagtggctactagatgctcctgagctccccgagggccatctggaggactggctggagaagagagccaagcggctgagctcagccccaagtagcagggctgaacccatcagaaccactgtcttccagtaccccgtgggctggccaccagttcaggagctgcctccatccctgcgggcacccccacctggggggtggcctctgcagcccagagtccagtggggctgagccccttgcccccgactgacccccacgtggtcacttttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcaccaca

SEQ ID NO: 435692 - DNA, 1022 bp, Homo sapiens
acgcgaggacgcaggaggaggagcccggagctgcagccaccggggagccaggtaccttccgcgagacgtcgaggggcgagtcctagtctcttttctccgcactggaagacttgaacacttccttctctggtctctgtcacccaggctggagtgtagtggcgcaatctcagctggctggagccttgacctccttgggctcaagctatcctcccacctcagcctctcaaatagctgggactacaggggaagcgatacttctgtgactactgcgaccgctccttccaggacaacctccacaaccgcaagaagcacctgaacgggctgcagcacctcaaggccaagaaggtctggtacgacatgttccgagatgcagctgccatcttgctggatgagcagaacaagcggccctgcaggaagtttctactgacaggccagtgcgactttggctccaactgcagattttcccacatgtcagagcgagacctgcaggagctgagcatccaggtggaggaggagaggcgagccagggagtggctactagatgctcctgagctccccgagggccatctggaggactggctggagaagagagccaagcggctgagctcagccccaagtagcagggctgaacccatcagaaccactgtcttccagtaccccgtgggctggccaccagttcaggagctgcctccatccctgcgggcacccccacctggggggtggcctctgcagcccagagtccagtggggctgagccccttgcccccgactgacccccacgtggtcacttttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcaccaca

SEQ ID NO: 435693 - DNA, 835 bp, Homo sapiens
tttaaaaaaaaatttagacaatgtttttttctgatttcaaaggcttgtgtgctcgtaaaacttttgagaaatataaaggagtaaaaaagtcacccataatggcaccactcagataggaccactgttaacattttgctgtgtcttccaggatttttttatgcatttatatattttatatatttttaaacaaaaatagtatcatgctatatacattattttataagctgctttttctccctatcacacagtatgtctttcctcatcagtgcatataaatctgccttaattcttacacaggccgcatggcattctctgctgtggacgtgcatatgtattgaatcagtcccccacaggtggacacgaaggttattcccattgtctcgcagctcaatgtctgcctgcaaccccgctatttccttgggctcagttcctagagggctgaacccatcagaaccactgtcttccagtaccccgtgggctggccaccagttcaggagctgcctccatccctgcgggcacccccacctggggggtggcctctgcagcccagagtccagtggggctgagccccttgcccccgactgacccccacgtggtcacttttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcaccaca

SEQ ID NO: 435694 - DNA, 1077 bp, Homo sapiens
acgcgaggacgcaggaggaggagcccggagctgcagccaccggggagccaggtaccttccgcgagacgtcgaggggcgagtcctagtctcttttctccgcactggaagacttgaacacttccttctctgcagcaaagcacctgctctgagtggccatggggaagcgatacttctgtgactactgcgaccgctccttccaggacaacctccacaaccgcaagaagcacctgaacgggctgcagcacctcaaggccaagaaggtctggtacgacatgttccgagatgcagctgccatcttgctggatgagcagaacaagcggccctgcaggaagtttctactgacaggccagtgcgactttggctccaactgcagattttcccacatgtcagagcgagacctgcaggagctgagcatccaggtggaggaggagaggcgagccagggagtggctactagatgctcctgagctccccgagggccatctggaggactggctggagaagagagccaagcggctgagctcagccccaagtagcagggctgaacccatcagaaccactgtcttccagtaccccgtgggctggccaccagttcaggagctgcctccatccctgcgggcacccccacctggggggtggcctctgcagcccagagtccagtggggctgagccccttgcccccgactgacccccacgtggtcacttttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcaccacaaaaaaaaaaaaacatgcacaaataaaaaaacaccggcggggactataagggggggggggaaaagggggtttaaaagggggcctgtgcccaatgtgtccgggccctttttgttcaaagggggaaattggcggggccccctg

SEQ ID NO: 435695 - DNA, 699 bp, Homo sapiens
acgcgaggacgcaggaggaggagcccggagctgcagccaccggggagccaggtaccttccgcgagacgtcgaggggcgagtcctagtctcttttctccgcactggaagacttgaacacttccttctctgcagcaaagcacctgctctgagtggccatggggaagcgatacttctgtgactactgcgaccgctccttccaggacaacctccacaaccgcaagaagcacctgaacgggctgcagcacctcaaggccaagaaggtctggtacgacatgttccgagatgcagctgccatcttgctggatgagcagaacaagcggccctgcaggaagtttctactgacaggccagtgcgactttggctccaactgcagattttcccacatgtcagagcgagacctgcaggagctgagcatccaggtggaggagaagagagccaagcggctgagctcagccccaagtagcagttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcaccaca

SEQ ID NO: 435696 - DNA, 1052 bp, Homo sapiens
acgcgaggacgcaggaggaggagcccggagctgcagccaccggggagccaggtaccttccgcgagacgtcgaggggcgagtcctagtctcttttctccgcactggaagacttgaacacttccttctctggtctctgtcacccaggctggagtgtagtggcgcaatctcagctggctggagccttgacctccttgggctcaagctatcctcccacctcagcctctcaaatagctgggactacaggcagcaaagcacctgctctgagtggccatggggaagcgatacttctgtgactactgcgaccgctccttccaggacaacctccacaaccgcaagaagcacctgaacgggctgcagcacctcaaggccaagaaggtctggtacgacatgttccgagatgcagctgccatcttgctggatgagcagaacaagcggccctgcaggaagtttctactgacaggccagtgcgactttggctccaactgcagattttcccacatgtcagagcgagacctgcaggagctgagcatccaggtggaggaggagaggcgagccagggagtggctactagatgctcctgagctccccgagggccatctggaggactggctggagaagagagccaagcggctgagctcagccccaagtagcagggctgaacccatcagaaccactgtcttccagtaccccgtgggctggccaccagttcaggagctgcctccatccctgcgggcacccccacctggggggtggcctctgcagcccagagtccagtggggctgagccccttgcccccgactgacccccacgtggtcacttttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcaccaca

SEQ ID NO: 435697 - DNA, 990 bp, Homo sapiens
tttcattaaggaggtggaggaggagaggcgagccaggagtggctactagatgctcctgagctccccgagggccatctggaggactggctggagaagagagccaagcggctgagctcagccccaagtagcagggctgaacccatcagaaccactgtcttccagtaccccgtgggctggccacgcagcaaagcacctgctctgagtggccatggggaagcgatacttctgtgactactgcgaccgctccttccaggacaacctccacaaccgcaagaagcacctgaacgggctgcagcacctcaaggccaagaaggtctggtacgacatgttccgagatgcagctgccatcttgctggatgagcagaacaagcggccctgcaggaagtttctactgacaggccagtgcgactttggctccaactgcagattttcccacatgtcagagcgagacctgcaggagctgagcatccaggtggaggaggagaggcgagccagggagtggctactagatgctcctgagctccccgagggccatctggaggactggctggagaagagagccaagcggctgagctcagccccaagtagcagggctgaacccatcagaaccactgtcttccagtaccccgtgggctggccaccagttcaggagctgcctccatccctgcgggcacccccacctggggggtggcctctgcagcccagagtccagtggggctgagccccttgcccccgactgacccccacgtggtcacttttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcaccaca

SEQ ID NO: 435698 - DNA, 1114 bp, Homo sapiens
acgcgaggacgcaggaggaggagcccggagctgcagccaccggggagccagggtctctgtcacccaggctggagtgtagtggcgcaatctcagctggctggagccttgacctccttgggctcaagctatcctcccacctcagcctctcaaatagctgggactacaggcagcaaagcacctgctctgagtggccatggggaagcgatacttctgtgactactgcgaccgctccttccaggacaacctccacaaccgcaagaagcacctgaacgggctgcagcacctcaaggccaagaaggtctggtacgacatgttccgagatgcagctgccatcttgctggatgagcagaacaagcggccctgcaggaagtttctactgacaggccagtgcgactttggctccaactgcagattttcccacatgtcagagcgagacctgcaggagctgagcatccaggtggaggaggagaggcgagccagggagtggctactagatgctcctgagctccccgagggccatctggaggactggctggagaagagagccaagcggctgagctcagccccaagtagcaggccgcatggcattctctgctgtggacgtgcatatgtattgaatcagtcccccacaggtggacacgaaggttattcccattgtctcgcagctcaatgtctgcctgcaaccccgctatttccttgggctcagttcctagagggctgaacccatcagaaccactgtcttccagtaccccgtgggctggccaccagttcaggagctgcctccatccctgcgggcacccccacctggggggtggcctctgcagcccagagtccagtggggctgagccccttgcccccgactgacccccacgtggtcacttttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcaccaca

SEQ ID NO: 435699 - DNA, 1151 bp, Homo sapiens
gcgccgcgggggttgcccgagcggcgctgcgggggctgacatgtcgtcccggcctgggcgcgaggacgtgggggctgcgggcgcgcggcggccgcgtgagccgccggagcaggagctgcagcgacgtcgggagcagaagcggcggcgacacgacgcgcagcagctgcagcagctcaagcacctggagtccttttacgaaaaacctcctcctgggcttatcaaggaagatgagactaagccagaagattgcataccagatgtaccaggcaatgaacacgccagggaatttctggctcatgcaccaactaaaggactttggatgccactggggaaagaagtcaaagttatgcagtgttggcgttgcaaacgctatggtcaccgaacgggtgacaaagaatgccctttctttatcaaaggcaaccaaaagttagagcagttcagagtggcacatgaagatcccatgtatgacatcatacgagacaataaacgacatgaaaaggacgtaaggatacagcagttaaaacagttactggaggattctacctcagatgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagcagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattcctttgaagtgtctcccacagggtggcaggactgggagaatctctgaggcgtgtcttccaggccctcccacagcttgtgccctccacagtgtggactcaggtcccatagacatcaggctggagtcttctctgttgttgagaataataaaagctcattatttattttttaaaaaaaagta

SEQ ID NO: 435700 - DNA, 741 bp, Homo sapiens
aaacacctcgccttcagaatttccttcccatcttgctgcctgtcccatctggagacttgcgtgctcagcattctgggtctcctctgggttcagtccctggatggaaataaggaaggcctggccagtcttagatggcaggtgccgctcagcacagggaggagaagcattctgctcttctcagttacgaaaaacctcctcctgggcttatcaaggaagatgagactaagccagaagattgcataccagatgtaccaggcaatgaacacgccagggaatttctggctcatgcaccaactaaaggactttggatgccactggggaaagaagtcaaagttatgcagtgttggcgttgcaaacgctatggtcaccgaacgggtgacaaagaatgccctttctttatcaaaggcaaccaaaagttagagcagttcagagtggcacatgaagatcccatgtatgacatcatacgagacaataaacgacatgaaaaggacgtaaggatacagcagttaaaacagttactggaggattctacctcagatgaagataggagcagctccagttcctctgaaggtaaagagaaacacaagaaaaagaagaagaaagaaaagcataaaaaaaaatagaaaaaaaaaaaccggggggtttttttggggggggggaaaaagggtttagagggggcgggagttttcggccttttttgaaaaggggaaaagggggcccaaggggggaaatgagggggcg

SEQ ID NO: 435701 - DNA, 367 bp, Homo sapiens
aagcagtaactctgaggagatctgacagctatgcagtcccgctccctggtacaggcatcgcgcctgcagctccctttctttatcaaaggcaaccaaaagttagagcagttcagagtggcacatgaagatcccatgtatgacatcatacgagacaataaacgacatgaaaaggacgtaaggatacagcagttaaaacagttactggaggattctacctcagatgaagataggagcagctccagttcctctgaaggtaaagagaaacacaagaaaaagaagaagaaagaaaagcatttgaagaaaagagggaagataaaggaaagaaaaacattttctgaggcatgccaacagtacaatcactacagcc

SEQ ID NO: 435702 - DNA, 711 bp, Homo sapiens
atattctgctgattctttatcttgagtaggtgaaactgttatcttacagaaatatttctcttttcgtttttaggttggcgttgcaaacgctatggtcaccgaacgggtgacaaagaatgccctttctttatcaaaggcaaccaaaagttagagcagttcagagtggtaagtaaagtccaagagtgtcaatttacatttatcagagatagtgaaaatcagtgaagcagaaagtcaccagtgaacttgaatggtcacataaaatacattcccagaagccctttgaccaaagtgtgtgctgttaactacatgcttattaaattacatttgtatgacaaattagctcttttacaaaaaaaaggaattcttattaaagtgatctttgtttgtaacttggaacagtgattttttttctgaaacagacattgttatctattcaaccgcactttttaaaatttactgtgtaaaaaagtcatgtttcatgactgaaatcagggatttaatttcccggtctttaaagagtacatgtctttaaactgtaagattaaagtgtccgtatattttttctttagatgacagttattccctgtatttttctttgtttttgaggtggcagtgttatagctctgtgattgctcctgcagagcagggctaccccaaagacagtgtgctgagagtagccatttcctgtatttttctaattggaaaatccat

SEQ ID NO: 435703 - DNA, 589 bp, Homo sapiens
gcgccgcgggggttgcccgagcggcgctgcgggggctgacatgtcgtcccggcctgggcgcgaggacgtgggggctgcgggcgcgcggcggccgcgtgagccgccggagcaggagctgcagcgacgtcgggagcagaagcggcggcgacacgacgcgcagcagctgcagcagctcaagcacctggagtccttttacgaaaaacctcctcctgggcttatcaaggaagatgagactaagccagaagattgcataccagatgtaccaggcaatgaacacgccagggaatttctggctcatgcaccaactaaaggactttggatgccactggggaaagaagtcaaagttatgcagtgtgagtgtgggagagtttccctaatccatgcaacttacatgcctcaatttacaaagagtgtttacttcttttatttaacttgttctcatcacagccctcttacagccaaggcacgttctccatcttctagataaggaagcatccaccccaccccccaccaccgtgccatgtgaagaagaaagagggctgtcatcttaagccaggaagaaagctctcaccacaaacccaccttgctg

SEQ ID NO: 435704 - DNA, 526 bp, Homo sapiens
aagcattctgctcttctcaggtgattgcttgtctgcaaaccagtgataaaagcttattgttgctaaaatctctgattaaaaatcctatagccccttttttgcagtaacttgatgtgttatgtttacattaacatggttgataaggttttgttttttgttttccagttacgaaaaacctcctcctgggcttatcaaggttagtgtgaagtttgtactcttggttattccacaagacatacttgtagactcagtaacttgttatgaaaaataattgcatgatgttaaatctccttttaccaaaagcctgtttcttttcctgcagatgaatgaggggtcataatttttagttttgtcacaagcctctgcctttgcagaaatttcatcagccatgtttcccttccctgaagaaccagtgcaggcccacgtggattccttggccatgcccctcttctctcttgctggggatggcatctctaagctccttttccttgtcggcctcacccggctcagcccctcggtccatcct

SEQ ID NO: 435705 - DNA, 254 bp, Homo sapiens
tactgcttttgaatgacatatttatctaagcaactgttgtaagttaaagctaaaactcactgttctttgatcaattttgaatgtttaggatacagcagttaaaacagttactggaggattctacctcagatgaagataggagcagctccagttcctctgaaggtaaagagaaacacaagaaaaagaagaagaaagaaaagcataagaaaaggaagaaagaaaagaaaaagaagaaaaaacggaagcacaaatct

SEQ ID NO: 435706 - DNA, 830 bp, Homo sapiens
aaggctaggtacgaggctggggttgaatcggcaccgaggattatctgcctggacctgtcagaggaaatgtcactgccaaagctggagtcgttcaacggccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaagaagtccacgccaatcactttg

SEQ ID NO: 435707 - DNA, 1061 bp, Homo sapiens
tcactaatttttttaatccaatcacatttcatactttgctccagtgtagccaatcacattccaggtcccgccgcacccagctccaggcagctctcactccaaaccccacccccaacccagtttcagcctatcagtttccaagttctttctagcctcaaccagtttctgtctctgcttgttctgcagcccgctgaactacatttcctgatcagcgaggcgtcgggggctgcgccgtacaacttccggctgtaaagatggcggcttcctagtgagtcggcggctgatttagaaggaggttcaggctacggtgagccgaagaggtgggtggtgaaagcgtgtggggcccgttcctaggggcccagctccctttgccccaagagatccagctcctcgcctttcctggggcttccgcctttatttctggtttctcctgcagtgtagcctccatccttcttgctgccgctaaagccttgtttttcttagaggtgtggggactgcaaggcgctcaaagaccatcttgggaagcccgtgcctatttcccagatagacaaactgctccattcgcgtcctgtttctctccaaggggaaccacagtactaatattttgcttctccctcatgcagacacccgctagggacgagggtgtcctagaggttattattcccttattcaccaagacattttcagttttaggtaacagaaaaccctactcaatctggcttaaggaagaaaaggaagttggtggcttatagattgggtctaacaggagctgggtccaggtggtcagaattcgatctgcagttttctcggtggagaccatttcgctttttaccgaggcaaaaggggcccctcacagctctcaactttattctaccagctctgcaactctaatgagagtctcttttccttgatgacactgctagaagttgcagagctgccactcaatggcctgatttgggtcatgtgcccatccctgagccattttcagtggccagagagctgggatgtgctcactggccgagtaggggcatggggctagcactacgttaaaaaaaaaaaga

SEQ ID NO: 435708 - DNA, 979 bp, Homo sapiens
  misc_feature (979)..(979): n is a, c, g, or t
gccaggaactgtgggcacccattttctgtgtctcccagcccatttccactcctagtttgtcatgagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaagggggggggggggggaaaaatccggggcggggccccccacaagtggccgcccccccgccttttttgtagtggaaaacagacgcccccccctaaggatggagctattaaataaaaccggacgcggggcgcgggcgtcaacagcacgcggaggaggagagaacagcccgatcgcctgccgcgtctgcttgtggaggcggcccctgctcctgcgggggggacacgatctggcgggcgcaccgccccgcggatgtagcaggggcgcggcgggacataaaccccgcggggtgttcgaggggcacccccctacctagtgcgcgggcgaatatttgtctgtctttttattaaattaaggccgctctcaatataatcacgtgcttagcaatctagcagactgatatacaggacagcgcacacgtcaatgctgacacactacaagcagatgctaacaacagacaaatcagatctacgagcatggagcacgagacgcagacagaaaagacagtcagatacgtccgagactgttgctgccaccacattccatacacactacgcggan

SEQ ID NO: 435709 - DNA, 2266 bp, Homo sapiens
  misc_feature (1748)..(1748): n is a, c, g, or t
  misc_feature (1877)..(1877): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435710 - DNA, 1452 bp, Homo sapiens
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaagaagtccacgccaatcactttg

SEQ ID NO: 435711 - DNA, 2213 bp, Homo sapiens
  misc_feature (1695)..(1695): n is a, c, g, or t
  misc_feature (1824)..(1824): n is a, c, g, or t
taaatcggtcacggaggcgcggtccttagattagtatcgtgtcggtgtgactcttgaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435712 - DNA, 2202 bp, Homo sapiens
  misc_feature (1684)..(1684): n is a, c, g, or t
  misc_feature (1813)..(1813): n is a, c, g, or t
agggaaacattggctggtcaggctgggttaatcggacgaggattaaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435713 - DNA, 2224 bp, Homo sapiens
  misc_feature (1706)..(1706): n is a, c, g, or t
  misc_feature (1835)..(1835): n is a, c, g, or t
gcggagaagcaaacttaggctaggtacgaggctggtgtgcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435714 - DNA, 2381 bp, Homo sapiens
  misc_feature (1863)..(1863): n is a, c, g, or t
  misc_feature (1992)..(1992): n is a, c, g, or t
gcggagaagcaaacttaggctaggtacgaggctggtgtgcttcctagtgagtcggcggctgatttagaaggaggttcaggctacggtgagccgaaggctggtctcgaacttccaacctcaggtgatccacctgcctcggcctcccaaagtgctgggattacaggcatgagccaccgtgcccgaccgtaaccaaatgtttttaaaactccaatacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435715 - DNA, 2615 bp, Homo sapiens
  misc_feature (2097)..(2097): n is a, c, g, or t
  misc_feature (2226)..(2226): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaagagacggggtttcactgtgttggccgggatggtcttgatctcctgaccttgtgatctgcccgcctcagcctcccaaagtgctgggattacaggcgtgagccaccgcgcccggcccacactggggactctttgggggccatgactgggacctcttcagatccttaacactgggtccatggcggggaatgtttgctgaatgtgtgaatggtttctgcttggcaaactcctcttcaccctttagaacccaccccagatgtcccctcttctgagaagccctccagggatatgaagggcctgttggggtaacctctgcctgaacagcccttcactgacccccgcctccccggcaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435716 - DNA, 2140 bp, Homo sapiens
  misc_feature (1622)..(1622): n is a, c, g, or t
  misc_feature (1751)..(1751): n is a, c, g, or t
gcggagaagcaaacttaggctaggtacgaggctggtgtgcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggaattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435717 - DNA, 2573 bp, Homo sapiens
  misc_feature (2055)..(2055): n is a, c, g, or t
  misc_feature (2184)..(2184): n is a, c, g, or t
gcggagaagcaaacttaggctaggtacgaggctggtgtgcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaagagacggggtttcactgtgttggccgggatggtcttgatctcctgaccttgtgatctgcccgcctcagcctcccaaagtgctgggattacaggcgtgagccaccgcgcccggcccacactggggactctttgggggccatgactgggacctcttcagatccttaacactgggtccatggcggggaatgtttgctgaatgtgtgaatggtttctgcttggcaaactcctcttcaccctttagaacccaccccagatgtcccctcttctgagaagccctccagggatatgaagggcctgttggggtaacctctgcctgaacagcccttcactgacccccgcctccccggcaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435718 - DNA, 2225 bp, Homo sapiens
  misc_feature (811)..(811): n is a, c, g, or t
  misc_feature (1707)..(1707): n is a, c, g, or t
  misc_feature (1836)..(1836): n is a, c, g, or t
taaatcggtcacggaggcgcggtccttagattagtatcgtgtcggtgtgactcttgaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaatggttccaggngccgcattatttcttgggttggacgcatgtgtaacaatccacaattggcatctgaggagaacgaggaggagaattgagctggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435719 - DNA, 2248 bp, Homo sapiens
  misc_feature (1730)..(1730): n is a, c, g, or t
  misc_feature (1859)..(1859): n is a, c, g, or t
gcggagaagcaaacttaggctaggtacgaggctggtgtgcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaccttctccttagcacccccaccagatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435720 - DNA, 2162 bp, Homo sapiens
  misc_feature (1644)..(1644): n is a, c, g, or t
  misc_feature (1773)..(1773): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435721 - DNA, 2229 bp, Homo sapiens
  misc_feature (1711)..(1711): n is a, c, g, or t
  misc_feature (1840)..(1840): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435722 - DNA, 2120 bp, Homo sapiens
  misc_feature (1602)..(1602): n is a, c, g, or t
  misc_feature (1731)..(1731): n is a, c, g, or t
gcggagaagcaaacttaggctaggtacgaggctggtgtgcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435723 - DNA, 2041 bp, Homo sapiens
  misc_feature (1523)..(1523): n is a, c, g, or t
  misc_feature (1652)..(1652): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435724 - DNA, 2168 bp, Homo sapiens
  misc_feature (1650)..(1650): n is a, c, g, or t
  misc_feature (1779)..(1779): n is a, c, g, or t
gcggagaagcaaacttaggctaggtacgaggctggtgtgcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435725 - DNA, 2416 bp, Homo sapiens
  misc_feature (1898)..(1898): n is a, c, g, or t
  misc_feature (2027)..(2027): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaccacaatggcactgaggagaaggaggaggagatgagttggaagagacggggtttcactgtgttggccgggatggtcttgatctcctgaccttgtgatctgcccgcctcagcctcccaaagtgctgggattacaggcgtgagccaccgcgcccggcccacactggggactctttgggggccatgactgggacctcttcagatccttaacactgggtccatggcggggaatgtttgctgaatgtgtgaatggtttctgcttggcaaactcctcttcaccctttagaacccaccccagatgtcccctcttctgagaagccctccagggatatgaagggcctgttggggtaacctctgcctgaacagcccttcactgacccccgcctccccggcaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435726 - DNA, 2197 bp, Homo sapiens
  misc_feature (1679)..(1679): n is a, c, g, or t
  misc_feature (1808)..(1808): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaggcggggaatgtttgctgaatgtgtgaatggtttctgcttggcaaactcctcttcaccctttagaacccaccccagatgtcccctcttctgagaagccctccagggatatgaagggcctgttggggtaacctctgcctgaacagcccttcactgacccccgcctccccggcaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435727 - DNA, 2277 bp, Homo sapiens
  misc_feature (442)..(442): n is a, c, g, or t
  misc_feature (453)..(453): n is a, c, g, or t
  misc_feature (532)..(532): n is a, c, g, or t
  misc_feature (538)..(538): n is a, c, g, or t
  misc_feature (548)..(549): n is a, c, g, or t
  misc_feature (551)..(551): n is a, c, g, or t
  misc_feature (554)..(554): n is a, c, g, or t
  misc_feature (556)..(556): n is a, c, g, or t
  misc_feature (558)..(558): n is a, c, g, or t
  misc_feature (562)..(563): n is a, c, g, or t
  misc_feature (565)..(565): n is a, c, g, or t
  misc_feature (568)..(568): n is a, c, g, or t
  misc_feature (573)..(574): n is a, c, g, or t
  misc_feature (578)..(579): n is a, c, g, or t
  misc_feature (582)..(582): n is a, c, g, or t
  misc_feature (584)..(584): n is a, c, g, or t
  misc_feature (588)..(588): n is a, c, g, or t
  misc_feature (604)..(604): n is a, c, g, or t
  misc_feature (614)..(614): n is a, c, g, or t
  misc_feature (624)..(624): n is a, c, g, or t
  misc_feature (629)..(629): n is a, c, g, or t
  misc_feature (633)..(633): n is a, c, g, or t
  misc_feature (675)..(675): n is a, c, g, or t
  misc_feature (684)..(684): n is a, c, g, or t
  misc_feature (727)..(727): n is a, c, g, or t
  misc_feature (729)..(729): n is a, c, g, or t
  misc_feature (733)..(733): n is a, c, g, or t
  misc_feature (736)..(736): n is a, c, g, or t
  misc_feature (773)..(773): n is a, c, g, or t
  misc_feature (791)..(791): n is a, c, g, or t
  misc_feature (797)..(797): n is a, c, g, or t
  misc_feature (808)..(808): n is a, c, g, or t
  misc_feature (810)..(812): n is a, c, g, or t
  misc_feature (841)..(841): n is a, c, g, or t
  misc_feature (843)..(843): n is a, c, g, or t
  misc_feature (1759)..(1759): n is a, c, g, or t
  misc_feature (1888)..(1888): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatntgaatgcgcanatgtaagaggaaatgtaaatgcaaaagctgcgcagtagcttcaaagcgataaaaaacaaacgcccctctaatgtctccncagaanatgctttcanntnttncntnctcnnanaanaaaanngcgnncgngncgcngggcgcgcgctggggngggtgcaagntgaaaaggcntggangtanggaatgaaataaaaaaaaagagagatatgtagatgaatatangatatgganaaggaataatgttaaaaattaaatatggaaggaattttaagantnatanagnagaaaaatgagattaaggtaaaagagaaagtgaagangattaaaaagaaatatgngggggnggaaaataatngnnnaaagaagtaaaaattgaaagaaaaagttntnattgaaggagaaatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435728 - DNA, 1009 bp, Homo sapiens
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggaggctgaggcaggagaatcgcttgaacccgggaggcagaggttgcggtgagccgagatcgtgccgttgcac

SEQ ID NO: 435729 - DNA, 1915 bp, Homo sapiens
  misc_feature (1397)..(1397): n is a, c, g, or t
  misc_feature (1526)..(1526): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435730 - DNA, 1888 bp, Homo sapiens
  misc_feature (1370)..(1370): n is a, c, g, or t
  misc_feature (1499)..(1499): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435731 - DNA, 1564 bp, Homo sapiens
  misc_feature (1046)..(1046): n is a, c, g, or t
  misc_feature (1175)..(1175): n is a, c, g, or t
gcggagaagcaaacttaggctaggtacgaggctggtgtgcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagccccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435732 - DNA, 771 bp, Homo sapiens
  misc_feature (695)..(695): n is a, c, g, or t
  misc_feature (715)..(715): n is a, c, g, or t
  misc_feature (741)..(741): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggccagcagaaaactgagcttccggtcacagagaacgtgcagacgattcccccgccatatgtggtccgcaccactgcactncagcctggggcaacagagtnagacttcgtctcaaaaaataaattanattaggagcagccttgtaactgtttttacc

SEQ ID NO: 435733 - DNA, 839 bp, Homo sapiens
gcggagaagcaaacttaggctaggtacgaggctggtgtgcttcctagtgagtcggcggctgatttagaaggaggttcaggctacggtgagccgaagaggtgggtggtgaaagcgtgtggggcccgttcctaggggcccagctccctttgccccaagagatccagctcctcgcctttcctggggcttccgcctttatttctggtttctcctgcagtgtagcctccatccttcttgctgccgctaaagccttgtttttcttagaggtgtggggactgcaaggcgctcaaagaccatcttgggaagcccgtgcctatttcccagatagacaaactgctccattcgcgtcctgtttctctccaaggggaaccacagtactaatattttgcttctccctcatgcagacacccgctagggacgagggtgtcctagaggttattattcccttattcaccaagacattttcagttttaggtaacagaaaaccctactcaatctggcttaaggaagaaaaggaagttggtggcttatagattgggtctaacaggagctgggtccaggtggtcagaattcgatctgcagttttctcggtggagaccatttcgctttttaccgaggcaaaaggggcccctcacagctctcaactttattctaccagctctgcaactctaatgagagtctcttttccttgatgacactgctagaagttgcagagctgccactcaatggcctgatttgggtcatgtgcccatccctgagccattttcagtggccagagagctgggatgtgctcactggccgagtaggggcatggggctagcactacgttaaaaaaaaaaaga

SEQ ID NO: 435734 - DNA, 425 bp, Homo sapiens
tcagctcactgcaacctccgccttctgggttcaagcaattctctgactcagcctcctgagtagctgggattacaggcactcgccaccacgcctggctaatttttttgtatttttagtagagatggggtttcaccatcttgaccaggctggtgttgaactcctgacctcgtgatccacctgcctcagcctcccaaagtactggaattacaggcgtgagccactgtgcccggccctgagggaaccttaattcccctgtactctctgcctccccagctccaaaaccaacgccctcaatgtctcccagaagatgattgagatgttcgtgcggacaaaacacaagatcgacaaaagccacgagtttgcactggtggtggtgaacgatgacacggcctgggtgaggctgcggcaggcgctgggtgccctgg

SEQ ID NO: 435735 - DNA, 1962 bp, Homo sapiens
  misc_feature (1444)..(1444): n is a, c, g, or t
  misc_feature (1573)..(1573): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaagccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435736 - DNA, 1974 bp, Homo sapiens
  misc_feature (1456)..(1456): n is a, c, g, or t
  misc_feature (1585)..(1585): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagtgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435737 - DNA, 1805 bp, Homo sapiens
  misc_feature (1287)..(1287): n is a, c, g, or t
  misc_feature (1416)..(1416): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaaaaaaaaaaaaaaaaaaaaaaaaaaaaaaaggggggggggcccaaaagtttccccgggggggcccaatttcgcgtccccggtttttttggtccaagggggcccctatgggggggggttaataagagggggggcgccgctcgtttacacgacgtctcgggacaggtggcgaaaacccgtggcctacccggggcgacctttggcggaagaggaaccccctatactctgtgtgggtggcgcacatatggtgtcgccccaacacctcccctacagcaagaattttaagcgctccatagagggtacattactacaaccttttncaacgcggttattacggtgcgtttcacccccatcggcgcaaattaagcctcgcgcgctggaaagaaatttttgggcccaccggggacatattcattttgggtaacacaccttttttttttccgccgggnacctttgtcctgtaaaacaaaatcggcaccaaccacgacagcgccgaccgagcaccaacacccaggacaacaagcacaagaagatagccgcccagacgggcagaacaccgcgctacgagcggacgaaacaacacagtacccggtgacaagcggtaccacagacacacgcggcgcgcagggccgactaccccgaacggtcagtcctcgtacgccggacgccagagctcgtaggcgagagagagccaccgcggcacacgccgccgaagagcgaaggcgacagagcaggagcacgtaagccacggagagcaccgcacgaaagaacgtcagaccatggcccatcgccccgaccccaccgacagagggcacacgaacgaaccagaggtcgccgg

SEQ ID NO: 435738 - DNA, 397 bp, Homo sapiens
  misc_feature (211)..(211): n is a, c, g, or t
  misc_feature (214)..(214): n is a, c, g, or t
  misc_feature (216)..(216): n is a, c, g, or t
  misc_feature (280)..(280): n is a, c, g, or t
  misc_feature (291)..(291): n is a, c, g, or t
  misc_feature (310)..(310): n is a, c, g, or t
  misc_feature (312)..(312): n is a, c, g, or t
gcggagaagcaaacttaggctaggtacgaggctggtgtgcttcctagtgagtcggcggctgatttagaaggaggttcaggctacggtgagccgaagtacggggaggattctggcttcccctgtccgtgttccatctagccacacaggagccatggaagtggcagagcccagcagccccactgaagaggaggagtcgtgccgaattcggcangcntnaaggctgcgttggggtgaggccctcacttcatccggcgactagcaccgcgtccggcagcgccancctacactcgnccgcgccatggcctctgtntncgagcttcgcctgcatctactcggccctcattctgcacgacgatgaggtgacaatcacggaggataagatcaattgccctcatta

SEQ ID NO: 435739 - DNA, 540 bp, Homo sapiens
tgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435740 - DNA, 828 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaaggtgaggaaatggaaatgtaatacacgcta

SEQ ID NO: 435741 - DNA, 4378 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435742 - DNA, 4796 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggtaagtgtgagaggcttgagggaagctgggctctgtcggcctcctcggcaggtgacccaccatgagcagcagcagccttccccttgcggggccaaagggagctgcctcttggccctgctctctcctgggagatgaaaggaacctcctcttcccatgttgaatttcttcccacagtggggaaatatcattaagtaacagacaaaaggcctgaggagcagggtggcttactcggctgtgaaacgacacctgggctgtcacgcccctgcacctctggccagtcagtgccgtaactgtggcaagactttctgaagttgcttttctcctccctgggattctggccttcccacgctagcattttgccaccacacccggtggtgggatgaggaggtgcccacggggcctttctcctttctgacaggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435743 - DNA, 4340 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435744 - DNA, 4329 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggaccccatgtgcacacatgcagcgcgtctttcgatcattccccgtcctgccgacttggcgagcgattcattcctgcttcaggaccctctcggtaccgagc

SEQ ID NO: 435745 - DNA, 3930 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435746 - DNA, 4883 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagtgagttgggaggcccgggcagtcgggggcagtcagggagtggggctgagctgcactgctgcctggaagagctcacacagttttctggaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggtaagtgtgagaggcttgagggaagctgggctctgtcggcctcctcggcaggtgacccaccatgagcagcagcagccttccccttgcggggccaaagggagctgcctcttggccctgctctctcctgggagatgaaaggaacctcctcttcccatgttgaatttcttcccacagtggggaaatatcattaagtaacagacaaaaggcctgaggagcagggtggcttactcggctgtgaaacgacacctgggctgtcacgcccctgcacctctggccagtcagtgccgtaactgtggcaagactttctgaagttgcttttctcctccctgggattctggccttcccacgctagcattttgccaccacacccggtggtgggatgaggaggtgcccacggggcctttctcctttctgacaggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435747 - DNA, 5175 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcaggtgaggagactgacccccttcctggccccaaggcctccttcctgcctggtccccaaggcctccttcctgcctggtccccatcggcccagcgcccacccagccttggcttttgcccgtgggccgttgggagcgccagcgcgggggcgggacgcggggcctccgacctcgggtccagtcctctgacctcggcctcacgtctgtggagtgaagatttgagaccgtgggacagtactgctggaagtagagaggaggagtcgaggctgggagagctcctgagagactgatggtgttttggtggaggattggccaggctacctaccgcttgtggcacaagggccctcaatctgtatgtagttcacttacacctgaacaggctgagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggtaagtgtgagaggcttgagggaagctgggctctgtcggcctcctcggcaggtgacccaccatgagcagcagcagccttccccttgcggggccaaagggagctgcctcttggccctgctctctcctgggagatgaaaggaacctcctcttcccatgttgaatttcttcccacagtggggaaatatcattaagtaacagacaaaaggcctgaggagcagggtggcttactcggctgtgaaacgacacctgggctgtcacgcccctgcacctctggccagtcagtgccgtaactgtggcaagactttctgaagttgcttttctcctccctgggattctggccttcccacgctagcattttgccaccacacccggtggtgggatgaggaggtgcccacggggcctttctcctttctgacaggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435748 - DNA, 3328 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttgtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435749 - DNA, 4706 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcaggaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggtaagtgtgagaggcttgagggaagctgggctctgtcggcctcctcggcaggtgacccaccatgagcagcagcagccttccccttgcggggccaaagggagctgcctcttggccctgctctctcctgggagatgaaaggaacctcctcttcccatgttgaatttcttcccacagtggggaaatatcattaagtaacagacaaaaggcctgaggagcagggtggcttactcggctgtgaaacgacacctgggctgtcacgcccctgcacctctggccagtcagtgccgtaactgtggcaagactttctgaagttgcttttctcctccctgggattctggccttcccacgctagcattttgccaccacacccggtggtgggatgaggaggtgcccacggggcctttctcctttctgacaggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435750 - DNA, 3499 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaa

SEQ ID NO: 435751 - DNA, 4165 bp, Homo sapiens
tccgctttgagcttcatagagacaacatcagagcctgcattgggctcactcatggccagggctccgatgtactcaccactgctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggtaagtgtgagaggcttgagggaagctgggctctgtcggcctcctcggcaggtgacccaccatgagcagcagcagccttccccttgcggggccaaagggagctgcctcttggccctgctctctcctgggagatgaaaggaacctcctcttcccatgttgaatttcttcccacagtggggaaatatcattaagtaacagacaaaaggcctgaggagcagggtggcttactcggctgtgaaacgacacctgggctgtcacgcccctgcacctctggccagtcagtgccgtaactgtggcaagactttctgaagttgcttttctcctccctgggattctggccttcccacgctagcattttgccaccacacccggtggtgggatgaggaggtgcccacggggcctttctcctttctgacaggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435752 - DNA, 3184 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagctactcaggaggctgaggcagcagaattgcttgaacccaggaggcagagtttgcagtgagccaagatcacaccactgcactccagcttggacgacagagcgagactctgtctcaaaaaataataggccaggcatgg

SEQ ID NO: 435753 - DNA, 3439 bp, Homo sapiens
gttgtgccatgctgctctgtcatgtttggtacgtgaatcgtccctttgtgcagcctatctatgctatgtgggctacctgcccgttagtagtcacctagggtatccaatcagctgtcctgatatcagagtgcctgtgttcaagtaactcttattttgctcagtggccccagattgcaagagtagtgatgctggcatgtcataatagttctattttagtatttgttattattgttgatctgttactatgcctagctcataaattaaactttctcataagtatgtatgtatagggaaaaaaacaacatatatatgggtttcggttctatctacggtttcaggcatccactggggtcttggaatgtatcctccaaggataaggaaggactagtgtattccccacacccctccctcttgctaccttttgctgcttttctttaatcaccctctcctcctgtggcctgtttctatatacttggcattctgtttgctttctttgttttgtcaatcacttcctttcttctctgcccaaaccctggttgcaggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435754 - DNA, 3435 bp, Homo sapiens
tttcacacccacgggctctatgtcgcaccataggctctatgtcacaaccacaggctctatctcacacccacgggctctgtctcacacctacgggctctgtctcacacccacgggctctatctcacacccatgggtctctatctcacacccacgggctctatgtcacaaccagaggctctatctcacacccatgggctctatctcacgtccatctgaccctcttaagatgggtcagatggaccgatggttgggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435755 - DNA, 3249 bp, Homo sapiens
gcgacggggctaccgtggttttatcagtgcaaatcgtccagataggtccacttagcctgctccggccgttgtgccgggcatttggcaaaccaagcgtgctgggccacccagtcgcacccgactgaaggggccttggccaggagacggcacttccagtgatgcaggggaacctggccgaccgtggtccccgcctcaagtgcatgctcgccattaggtctacaagttccccagcccctgcgatgagggcccattgcacgtgctataggaactgcgcagggttgtggatttcctttaactcaggctgcacgtgtgcgcaacacagggtagccctggacggcattcagtgattttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435756 - DNA, 2021 bp, Homo sapiens
  misc_feature (15)..(15): n is a, c, g, or t
atcctacacacaganaattgcttatgagtatcacattaccgctcttggttatcagttaacaaaggctgctaatgaacagcatcgttactcgtgccgaattcggcacgaggacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcaggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgctggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaacaaaatgaaaaatgaaacactga

SEQ ID NO: 435757 - DNA, 1988 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcacaggcacaggccctacccgagcaggccggagttggctcgcatgactccagctgaggctgcctgtgtacatttctccagataccctatggctaattttgttataactgcacagtggctgctgccattttgtattaaatatattgtgaa

SEQ ID NO: 435758 - DNA, 2023 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttgggcagaccttttccgcccaacacccacctgggagggagggcgagacccgaggtcagacgtccctggagcaggtgagcactgcgagggaactgagatgcaagatcctcctgcctgaactcacaccccgcgtgctgctcccccaactcgcctcttggatctcagaccagaagcttcctttcctcaaaatccttctatgttctccaacgtctttgggacagagctccttggcagggtttacaaagcttaggtggccctacccacttctccagcctcatctgctgcctcacccctataccacagctctgcacctttgctgaaactggtactcggcgcttggggtgtcctcatctttcccctacctatggcagcctgcccgaagagtgcctgctccttcaggctccgctctcggcttagccccttcttggaacgtccccgcacctcaccccagccccttccaggggcagaccctggcagccttccctcgtcctcagcagccattacgtgttgctgtcataaagttatcactctgtattctgtctact

SEQ ID NO: 435759 - DNA, 1852 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggccatgcccctcaacccttcctctacactgaaccagtgaactatcaagctccccgcaaattcttcagtggctcccagcacctgtaagatctaaggcttggcaaggcaaatatgactctgatccccctgggccttccccttctgctgcttccctccttccctgctgaatgttcgtgttcttgttgcaaggagtcctcactgccatgtttctcatccctgtgcctttggtctggggcagctctggaagtccttccagcccttcaaactttctcttgcttcctcatctctaaagcctcaggccagggcctgcctccttcaggaagacctctcttctccaaccttccctcattcctctgtctccatctcatccat

SEQ ID NO: 435760 - DNA, 1906 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagcctgggtccatggatcttggagtgtgttcagtaaacatctgctcctggggcaataatgaagggcagaccttttccgcccaacacccacctgggagggagggcgagacccgaggtcagacgtccctggagcaggtgagcactgcgagggaactgagatgcaagatcctcctgcctgaactcacaccccgcgtgctgctcccccaactcgcctcttggatctcagaccagaagcttcctttcctcaaaatccttctatgttctccaacgtctttgggacagagctccttggcagggtttacaaagcttaggtggccctacccacttctccagcctcatctgctgcctcacccctataccacagctctgcacctttgctgaaactggtactcggcgcttggggtgtcctcatctttcccctacctatggcagcctgcccgaagagtgcctgctccttcaggctccgctctcggcttagccccttcttggaacgtccccgcacctcaccccagccccttccaggggcagaccctggcagccttccctcgtcctcagcagccattacgtgttgctgtcataaagttatcactctgtattctgtctact

SEQ ID NO: 435761 - DNA, 1218 bp, Homo sapiens
tttccgcagttaggggctgctatttcaacgcagggagataaaaagaaaaaaacacttgctcttctaccccgctaaaaacactcatcctagggagcacgccagcatttgcagcgttcggggcagggccactcggcctgcggccgttgcactggctggaagctggcaggcgatcacggttgattggctcgggtgcggtccaagggcagcaacgccttcggcgggccgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctggtaagtagcaccgggaatcggggagcccctctcctgacccccttccaggctgatctggctgttctcaagttgagaaagcctctgggttaga

SEQ ID NO: 435762 - DNA, 560 bp, Homo sapiens
acacggattctgggagggctgcctatcttagcgagtgagggaggagtggagcatgggggtctctccatttcttccccggggaaagagatggtagagctcctggttggcaggcaggagccgctggggttgtggacagcgctaaaagagggctctctttcccctagggcagaccttttccgcccaacacccacctgggagggagggcgagacccgaggtcagacgtccctggagcaggtgagcactgcgagggaactgagatgcaagatcctcctgcctgaactcacaccccgcgtgctgctcccccaactcgcctcttggatctcagaccagaagcttcctttcctcaaaatccttctatgttctccaacgtctttgggacagagctccttggcagggtttacaaagcttaggtggccctacccacttctccagcctcatctgctgcctcacccctataccacagctctgcacctttgctgaaactggtactcggcgcttggggtgtcctcatctttcccctacctatggcagcctgcccgaagagtgcctgctccttcag

SEQ ID NO: 435763 - DNA, 659 bp, Homo sapiens
ctctggcttatcaggactccatagttctccaacagagaaatcttgaaaaggactgaccagtttttgcagttctaaaaccatggcccatggttcagtgacattcagggatgtggccatagacttctcacaggaagaatgggaattcctggatcctgctcagagggacttatatagggatgtaatgtgggagaactacagcaacttcatttcactagcaggaccttccatttctaaaccagatgtgattaccttattggatgaagaaaggaaggaacctgggatggttgtgagggaagggacaagaagatactgccctggtgagtgagggctgagcaggcattgagaaatcactactgcaggtaatagctaaactgattagggtggaggcacacccttgagatgttggggtctctcttcaaaaagcccctggcctatggaggcagggcttgggacttgaagcaaattaagatcttttaagcctggactagcaaaggaactttctattgatcttgaatgcaacactgtttctcatctttcatatttctatcctactttaaagagaagaactattcctggtagaagaaaaaataaataaatataagagcagaaatcagcaaaatagaaaagaaataaagaaaattaataaagccaaaaattga

SEQ ID NO: 435764 - DNA, 5648 bp, Homo sapiens
  misc_feature (3316)..(3316): n is a, c, g, or t
  misc_feature (3485)..(3485): n is a, c, g, or t
  misc_feature (3501)..(3501): n is a, c, g, or t
  misc_feature (3757)..(3757): n is a, c, g, or t
  misc_feature (3761)..(3761): n is a, c, g, or t
  misc_feature (3810)..(3810): n is a, c, g, or t
  misc_feature (3815)..(3815): n is a, c, g, or t
  misc_feature (3839)..(3839): n is a, c, g, or t
  misc_feature (3871)..(3871): n is a, c, g, or t
ctctggcttatcaggactccatagttctccaacagagaaatcttgaaaaggactgaccagtttttgcagttctaaaaccatggcccatggttcagtgacattcagggatgtggccatagacttctcacaggaagaatgggaattcctggatcctgctcagagggacttatatagggatgtaatgtgggagaactacagcaacttcatttcactagcaggaccttccatttctaaaccagatgtgattaccttattggatgaagaaaggaaggaacctgggatggttgtgagggaagggacaagaagatactgccctgatttggagtccagatacaggaccaatactttatctccagaaaaggacatttatgaaatatattcatttcagtgggatataatggaaagaattaaaagctatagccttcagggttccatttttaggaatgattgggaatgcaaaagcaagattgagggggaaaaggaacaacaagagggatattttgggcaagtgaaaattacctctgaaaaaatgaccacttacaaaaggcacaattttcttactgagtatcagatcgttcataatggagaaaaggtgtatgagtgtaaggagtgtaggaagacctttattcgtcgctcaacacttagtcaacacctgagaattcatactggtgagaaaccttataagtgtaaggaatgtgggcaggcctttagacagcgtgcacatcttattcgacatcacaaacttcacaccggtgagaaaccctatgaatgtaaggagtgtgggaaggcctttacagtgctccaagaacttactcaacatcagagacttcatacgggtgaaaaaccctatgaatgtaaggaatgtggaaaggcctttagagtacatcagcaactggctcgacatcagagaattcacactggtgagaaaccctatgaatgtaaggactgtggaaagacctttagacagtgtacacaccttacacgccatcagagacttcatactgctgaaaagctctatgaatgtaaggaatgtgggaaagccttcgtatgtggtccagaccttagagtacatcagaaaattcattttggtgagaaaccctatgaatgtaaggagtgtggaaaggcttttagaatatgccaacaacttactgttcatcagagtattcatactggtgagaaaccctacgaatgtaaggaatgtgggaagacttttagattaagacaacaactagttcgccatcagagaatacatactcgtgagaaaccctatgaatgtatggaatgttggaagacctttagtagttactcacagcttatttcacaccagagcattcatattggtgagagaccctatgaatgtgaagagtgtggaaaggcctttagactgctctcacaacttactcagcatcaaagtattcacactggtgagaaaccttatgaatgtaaggaatgtagaaaaccttttagactgctctcacaacttacccaacatcagagtattcacactggtgagaaaccttatgaatgtaaggaatgtggtaaggcttttagactttattcatttcttactcaacaccagagaattcatactggtgagaagccctacaagtgtaaggagtgtaagaaggcctttagacagcattcacaccttactcagcatcagaagattcataatggaatttaatagaagaaagccttcaaatgtatatgatgttacagaacatcagaaaattcatttttgagaaaatgtgtttcatgctcaattccaagcataataaattttatattagagaaagaatatgttgatttaaaagccttccaacaccatttaaacatggtttatcttcagcaaattcctatgagagaataatgtaatgaatgtaggaaaatctttagccttatctgtcattatctccctttctccacttgattaccagtttgatttattggacaagatactaagcttctgtgcctcattttgctgacttgtaaaatggtaataatagtacttatatgtattagttatttattgctgcgtaataaattaccacagacttagtagcataaaataacatataattatatcttataatttggatcaggagtataggcatgacttagttgggtcctctgcttcagggtctcttgcaaggctacagatttcagccagggctgaggtctcatctgaaggctcaactggggaaggatccacatccagactaacatagttgttacccaatgtatttccgtgaggcctgttgcattgagattctcagtttctagctggctgttggctgaacgctgactgcagctcctggccacaatagcctcatcaacatggctgcttgcttcatcaaggcatgcaagccaaaagggaggacagtctgctagcaagatggaagttaccatcttgtgtaatctaatcatggaagtaacattccctcaccttctactggtagaagtaagttactaggatagtccacactcaagagaacgggatgatacaagagtgtgaataagtcctggagacaggaccactggggggcctgtttagagtcagcctgccacactgtggaataggattgttgcaaggagtaagtagttaatacttggaggaatcacagtcatatagcatgtattctgtaaatattatctgtaattgttattattgtcattagtattagtgaattcacgtaaaaggaagatctgtagacataataaatgtagaaatgcctcctgtcacctctcagaaattattaaacataatttattctaggtaaaatttagattgtagtgaatgtaggaagttcttcagcacttgagctgcattagaaatttcatgccaaaaatgaatttcatgaatgtgaggtcactagtaatacagctgttgaagaattagagggaaataggaaatgattttcccataattccagaaagcaaaaggcttacaatccctgttgtctgaccacagtttaaaattaattagaaactatcaaaaatgtggcttaaaagaaattaaccacctaggaatttaatattgttgtgtatatttatgtgtgtgtataaaactcctgtgggaaagaaacaaaacatcattctataagtcagtatacttttggatgctcaaaatgccatatcttcaaccagtaggagttgtttcaagttgagtttttgatgtgatcccaccaataatttgatagtttacttgattgtggctgcataatttggtaacctatgaaagatgctagagcaccaatgtataatttttttgagacagggtgtcactttgtcccccaggctggagtgcagtggtacnagcacagttcactgtaccctgttcctcctgggctcaagtgattcttccacctaaattttttttttttttttagagaaagggtctcactatgttgcccaggctggtcttgaacttctgggctcaagtgatcctccctccttggcctccaaaggtgctggggttacaggtntgagccaccacacccngcccaactcattattcttgaaatcaataaatcagaggaaaaattgtcatttagtttccttttcccatgtgaaccaaatttcagggtcaccagaagttcatcaaattcaaatgaatttggcctggcacaggggtcacacctgtaatcccagcactttgggaggacaaggtgggtggatcacttgaggccaggagtttgagaccaacctggttaacatggtgaaaccctgtctgtactaaaaatacaaaatttagccnggcntggtggcacacacctgtagtcccaggctgaggtgggaggatcacttgancccangaggcagagtttgcagtgagctgngatcgtgccactgcactccagcctgggtgacngagtgagaccctgtctcaaaaaaaaaatttgttttttgaatgggtttttcttttttgaagaagtctaataaatctagaaggaattagaggattagaaaaatcaccattttctagaccttaatggaataatgggtccagaaaacatgatcttcaatgggtactacaactaataggtgaaatattttatagcgagatttttatggtggatctatcaaactggccacctctgaaccctttgatctgttttaaccttaataaaaatgggtctatcagacaacacacttcctgacgtaatgcaataggaagtccacaccaccatctacaaagccttattgctggaataatgaactgaaagcagacagggactagatgaacagtatatggtcatcccttggtatccatggggaattggttccaggatcctccactgatggtaaaatctgaggatgctcaagtcccttgtataaaatggcatagtatgtatttgcatattacctactcacatcttcctgtatactttaaattatctttagatcacttatacctatcacaatgtaaatactatgtaaatagttgttatactgtatttttcaatttgcattatttttattgtattttatttttattgtttttttttgagtattttctatttgagattggttgaatctgcacatatggagggctggctataaagggcaccacaaggaagaagccaaacagatccagaatgtgtgaaattctacagagcaaattacctgatttcttcaactaacaggtagcatgaaaatacaaggggaagggcaaccattaacagattaaaagagacttaaagagacatatcaactaaattcagtatgttggcattacttggacctggtttgaacaaaacataaaaagccattttggagacagtgagggaagtgtggacatggactaaatattaaatgatatttacatatattaatttggttagggattatgtcagtgtgattataaaaaataaaagatcgtatgatatgagatacatactatgaaatgaagatagacacatttggattaaaatattctagcaaaagaaataattggcaaagagagctggaaactaaattggcaacatgttgataatttaagtggagtgttttgttcatggagacttattgttctaatatttctacttttgtatgtgtttgaaatttcaataataaaatgtttaaaatcaaaaccaaaattatagactatgtagaaatgaatgacagtgagatgcctgcacatctaaccttgtcagatataatcaaagttctgttcagtgacaaattaatgccctgtaatgtggtaaggaaatcttatttgtggatacagtcttcatcttcttcacttacccacagcagcaacaccaggcctgtcacacagatgaatgtgttgagggaatgaataagtatttccgtcaagaaaaaggaaacaacaaaataaaaccaacccaagtaaagaacagccaagtggccaggtgcggtggctcatgcctgtaatcccagcactttgggaggccatggcaggtggatcacctgaggtcgggattttgagaccagcctgaccaacactgagaaaccccatctctattaaagatacaaaattagccaggcatggtggtgcatgcctgtaatcccagctacttgggaggctaaggcaggagaatcacttgaatccaggaggcggagtttgtggtgagttgagatcgcgccactgcactccagcctgggtaacagagcaagagtctgtc

SEQ ID NO: 435765 - DNA, 5407 bp, Homo sapiens
  misc_feature (3316)..(3316): n is a, c, g, or t
  misc_feature (3485)..(3485): n is a, c, g, or t
  misc_feature (3501)..(3501): n is a, c, g, or t
  misc_feature (3757)..(3757): n is a, c, g, or t
  misc_feature (3761)..(3761): n is a, c, g, or t
  misc_feature (3810)..(3810): n is a, c, g, or t
  misc_feature (3815)..(3815): n is a, c, g, or t
  misc_feature (3839)..(3839): n is a, c, g, or t
  misc_feature (3871)..(3871): n is a, c, g, or t
ctctggcttatcaggactccatagttctccaacagagaaatcttgaaaaggactgaccagtttttgcagttctaaaaccatggcccatggttcagtgacattcagggatgtggccatagacttctcacaggaagaatgggaattcctggatcctgctcagagggacttatatagggatgtaatgtgggagaactacagcaacttcatttcactagcaggaccttccatttctaaaccagatgtgattaccttattggatgaagaaaggaaggaacctgggatggttgtgagggaagggacaagaagatactgccctgatttggagtccagatacaggaccaatactttatctccagaaaaggacatttatgaaatatattcatttcagtgggatataatggaaagaattaaaagctatagccttcagggttccatttttaggaatgattgggaatgcaaaagcaagattgagggggaaaaggaacaacaagagggatattttgggcaagtgaaaattacctctgaaaaaatgaccacttacaaaaggcacaattttcttactgagtatcagatcgttcataatggagaaaaggtgtatgagtgtaaggagtgtaggaagacctttattcgtcgctcaacacttagtcaacacctgagaattcatactggtgagaaaccttataagtgtaaggaatgtgggcaggcctttagacagcgtgcacatcttattcgacatcacaaacttcacaccggtgagaaaccctatgaatgtaaggagtgtgggaaggcctttacagtgctccaagaacttactcaacatcagagacttcatacgggtgaaaaaccctatgaatgtaaggaatgtggaaaggcctttagagtacatcagcaactggctcgacatcagagaattcacactggtgagaaaccctatgaatgtaaggactgtggaaagacctttagacagtgtacacaccttacacgccatcagagacttcatactgctgaaaagctctatgaatgtaaggaatgtgggaaagccttcgtatgtggtccagaccttagagtacatcagaaaattcattttggtgagaaaccctatgaatgtaaggagtgtggaaaggcttttagaatatgccaacaacttactgttcatcagagtattcatactggtgagaaaccctacgaatgtaaggaatgtgggaagacttttagattaagacaacaactagttcgccatcagagaatacatactcgtgagaaaccctatgaatgtatggaatgttggaagacctttagtagttactcacagcttatttcacaccagagcattcatattggtgagagaccctatgaatgtgaagagtgtggaaaggcctttagactgctctcacaacttactcagcatcaaagtattcacactggtgagaaaccttatgaatgtaaggaatgtagaaaaccttttagactgctctcacaacttacccaacatcagagtattcacactggtgagaaaccttatgaatgtaaggaatgtggtaaggcttttagactttattcatttcttactcaacaccagagaattcatactggtgagaagccctacaagtgtaaggagtgtaagaaggcctttagacagcattcacaccttactcagcatcagaagattcataatggaatttaatagaagaaagccttcaaatgtatatgatgttacagaacatcagaaaattcatttttgagaaaatgtgtttcatgctcaattccaagcataataaattttatattagagaaagaatatgttgatttaaaagccttccaacaccatttaaacatggtttatcttcagcaaattcctatgagagaataatgtaatgaatgtaggaaaatctttagccttatctgtcattatctccctttctccacttgattaccagtttgatttattggacaagatactaagcttctgtgcctcattttgctgacttgtaaaatggtaataatagtacttatatgtattagttatttattgctgcgtaataaattaccacagacttagtagcataaaataacatataattatatcttataatttggatcaggagtataggcatgacttagttgggtcctctgcttcagggtctcttgcaaggctacagatttcagccagggctgaggtctcatctgaaggctcaactggggaaggatccacatccagactaacatagttgttacccaatgtatttccgtgaggcctgttgcattgagattctcagtttctagctggctgttggctgaacgctgactgcagctcctggccacaatagcctcatcaacatggctgcttgcttcatcaaggcatgcaagccaaaagggaggacagtctgctagcaagatggaagttaccatcttgtgtaatctaatcatggaagtaacattccctcaccttctactggtagaagtaagttactaggatagtccacactcaagagaacgggatgatacaagagtgtgaataagtcctggagacaggaccactggggggcctgtttagagtcagcctgccacactgtggaataggattgttgcaaggagtaagtagttaatacttggaggaatcacagtcatatagcatgtattctgtaaatattatctgtaattgttattattgtcattagtattagtgaattcacgtaaaaggaagatctgtagacataataaatgtagaaatgcctcctgtcacctctcagaaattattaaacataatttattctaggtaaaatttagattgtagtgaatgtaggaagttcttcagcacttgagctgcattagaaatttcatgccaaaaatgaatttcatgaatgtgaggtcactagtaatacagctgttgaagaattagagggaaataggaaatgattttcccataattccagaaagcaaaaggcttacaatccctgttgtctgaccacagtttaaaattaattagaaactatcaaaaatgtggcttaaaagaaattaaccacctaggaatttaatattgttgtgtatatttatgtgtgtgtataaaactcctgtgggaaagaaacaaaacatcattctataagtcagtatacttttggatgctcaaaatgccatatcttcaaccagtaggagttgtttcaagttgagtttttgatgtgatcccaccaataatttgatagtttacttgattgtggctgcataatttggtaacctatgaaagatgctagagcaccaatgtataatttttttgagacagggtgtcactttgtcccccaggctggagtgcagtggtacnagcacagttcactgtaccctgttcctcctgggctcaagtgattcttccacctaaattttttttttttttttagagaaagggtctcactatgttgcccaggctggtcttgaacttctgggctcaagtgatcctccctccttggcctccaaaggtgctggggttacaggtntgagccaccacacccngcccaactcattattcttgaaatcaataaatcagaggaaaaattgtcatttagtttccttttcccatgtgaaccaaatttcagggtcaccagaagttcatcaaattcaaatgaatttggcctggcacaggggtcacacctgtaatcccagcactttgggaggacaaggtgggtggatcacttgaggccaggagtttgagaccaacctggttaacatggtgaaaccctgtctgtactaaaaatacaaaatttagccnggcntggtggcacacacctgtagtcccaggctgaggtgggaggatcacttgancccangaggcagagtttgcagtgagctgngatcgtgccactgcactccagcctgggtgacngagtgagaccctgtctcaaaaaaaaaatttgttttttgaatgggtttttcttttttgaagaagtctaataaatctagaaggaattagaggattagaaaaatcaccattttctagaccttaatggaataatgggtccagaaaacatgatcttcaatgggtactacaactaataggtgaaatattttatagcgagatttttatggtggatctatcaaactggccacctctgaaccctttgatctgttttaaccttaataaaaatgggtctatcagacaacacacttcctgacgtaatgcaataggaagtccacaccaccatctacaaagccttattgctggaataatgaactgaaagcagacagggactagatgaacagtatatggtcatcccttggtatccatggggaattggttccaggatcctccactgatggtaaaatctgaggatgctcaagtcccttgtataaaatggcatagtatgtatttgcatattacctactcacatcttcctgtatactttaaattatctttagatcacttatacctatcacaatgtaaatactatgtaaatagttgttatactgtatttttcaatttgcattatttttattgtattttatttttattgtttttttttgagtattttctatttgagattggttgaatctgcacatatggagggctggctataaagggcaccacaaggaagaagccaaacagatccagaatgtgtgaaattctacagagcaaattacctgatttcttcaactaacaggtagcatgaaaatacaaggggaagggcaaccattaacagattaaaatattctagcaaaagaaataattggcaaagagagctggaaactaaattggcaacatgttgataatttaagtggagtgttttgttcatggagacttattgttctaatatttctacttttgtatgtgtttgaaatttcaataataaaatgtttaaaatcaaaaccaaaattatagactatgtagaaatgaatgacagtgagatgcctgcacatctaaccttgtcagatataatcaaagttctgttcagtgacaaattaatgccctgtaatgtggtaaggaaatcttatttgtggatacagtcttcatcttcttcacttacccacagcagcaacaccaggcctgtcacacagatgaatgtgttgagggaatgaataagtatttccgtcaagaaaaaggaaacaacaaaataaaaccaacccaagtaaagaacagccaagtggccaggtgcggtggctcatgcctgtaatcccagcactttgggaggccatggcaggtggatcacctgaggtcgggattttgagaccagcctgaccaacactgagaaaccccatctctattaaagatacaaaattagccaggcatggtggtgcatgcctgtaatcccagctacttgggaggctaaggcaggagaatcacttgaatccaggaggcggagtttgtggtgagttgagatcgcgccactgcactccagcctgggtaacagagcaagagtctgtc

SEQ ID NO: 435766 - DNA, 1807 bp, Homo sapiens
agggatcccaccccttctctgtgttttcactctgaagctctacacaactttacacctgaatgaacgccaaacctctatggatatataaagggaagcttgaggaggaatttcacagttacagtgcagaagcagaggcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacactcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaaaggtgcttttttggtactcttcatgggaacagtttagcagccatgagtgatcttcctttgaaagagaatgaaagaccctgtgacatttcacttcaaaaataagccctgtagctctttacggtcgcatagtataaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagtta

SEQ ID NO: 435767 - DNA, 1795 bp, Homo sapiens
aacgcagttcccggcaacccacttgaacccgagtgttccgatccagtccagtgttactgaaatgcctgcctccatttctggcttgattcaacgagctgttgctgctggggtgtgctggaacagcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacactcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaaaggtgcttttttggtactcttcatgggaacagtttagcagccatgagtgatcttcctttgaaagagaatgaaagaccctgtgacatttcacttcaaaaataagccctgtagctctttacggtcgcatagtataaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagtta

SEQ ID NO: 435768 - DNA, 1873 bp, Homo sapiens
agggatcccaccccttctctgtgttttcactctgaagctctacacaactttacacctgaatgaacgccaaacctctatggatatataaagggaagcttgaggaggaatttcacagttacagtgcagaagcagaggcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacactcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaaaggtgcttttttggtactcttcatgggaacagtttagcagccatgagtgatcttcctttgaaagagaatgaaagaccctgtgacatttcacttcaaaaataagccctgtagctctttacggtcgcatagtataaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagttattgttgttgcctctaacatgtataaagggtgcaaaaattgtagaataaatgtataagggtaattgc

SEQ ID NO: 435769 - DNA, 1753 bp, Homo sapiens
agggatcccaccccttctctgtgttttcactctgaagctctacacaactttacacctgaatgaacgccaaacctctatggatatataaagggaagcttgaggaggaatttcacagttacagtgcagaagcagaggcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacactcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgactacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaaaggtgcttttttggtactcttcatgggaacagtttagcagccatgagtgatcttcctttgaaagagaatgaaagaccctgtgacatttcacttcaaaaataagccctgtagctctttacggtcgcatagtataaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagtta

SEQ ID NO: 435770 - DNA, 926 bp, Homo sapiens
caggatgggtcttaatatgtagtggagaggggttggtgaaacagtacttttcatctctatgttggggtagagacttgctgactgagtgtagggctgattgcaaatgaagatttccctgcccactaaggttttagggaagggctttggccaatctgctttatctcagatgtgtgataactaggcctaaggcaataatccttgagcaaaagactcttgctctggcacctggatacctatcttatggagttattctaaggattaagagataatagatataaagcacctaatacagttagagtacatcttaaacatgtaatgtatcgagctattacagagagttaactgattacaggaacgtggagtggtaagttaaacaaacctggccacctgcttataaagcaatataatggtatgtgtaacaatctggatcaactttcttcaaaaacggtgtgctttgaaatgccaggatggctgattttacttattttaattaatttttctttgttgctttcagtgaagcaaagaactgccttgtagataaacatattgcatttattggagattccagaattcgtcaattgttttattcttttgtaaaaataattaatccccaattcaaagaagaaggaaataaggtaaaacttgtctattcccttctgtagagtgttttagaagttaaccaactgaatagttacaggaggagtgtgtctctccagattgagtaggagctgaaaaaattttactttgattttcagaaaggttggggaaaaagagggatgaattgctttaatgaggaagatgacaaaaagaagtggtggctaagacattggcaagctttttattgtaataacttaaacttttagttttcagaaataataaattcttaccatggaaaaacttttaaatttccttagaaagaagacaaa

SEQ ID NO: 435771 - DNA, 395 bp, Homo sapiens
caggatgggtcttaatatgtagtggagaggggttggtgaaacagtacttttcatctctatgttggggtagagacttgctgactgagtgtagggctgattgcaaatgaagatttccctgcccactaaggttttagggaagggctttggccaatctgctttatctcagatgtgtgataactaggcctaaggcaataatccttgagcaaaagactcttgctctggcacctggatacctatcttatggagttattctaaggattaagagataatagatataaagcacctaatacagttagagtacatcttaaacatgtaatgtatcgagctattacagagagttaactgattacaggaacgtggttggctcagggtttgacagagaaaagacaaataaa

SEQ ID NO: 435772 - DNA, 370 bp, Homo sapiens
tacatggagcagcaaaagcaagcagcaagcatgttcagtggaataaacgggggtaagctcgtatctaaagaaatggatagtagcagagtagttctgtattcctcatttgagaattagcgacggtctgtacccaaaatttcaaattttctgttgtttatttcagtagtttctttcttgacctattccatctgggctagcagttgtaaaaacaaagcagagtgcaatgaactccatccgtctgtttctgtggtacagattttagccttcatcgtccttttcccaatttaaaatacatcttatatccatctggtttttctttagcacttgctctattcatttccctttttgttcctctacttttagaacacat

SEQ ID NO: 435773 - DNA, 4068 bp, Homo sapiens
cctaaggctcgcgtccgggccaggcgggtacccctagtactctctccccacacccccatggctctgccgcagccgccgccgcccgccggggcgcgtgacccggtgaccccggagcactgggcatccggacccccctcgcaggcgcagccgctattaaggcaggaggctaaagaggaggaggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgaccgtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacatttttgcctgtatacatgcacattcgagttctggttgctgcatatttatttcagacagggtatgggcatttctcatacttttggataaaaggagattttggaatctatagagtatgtcaggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggctttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtttgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgctt

SEQ ID NO: 435774 - DNA, 4264 bp, Homo sapiens
cctaaggctcgcgtccgggccaggcgggtacccctagtactctctccccacacccccatggctctgccgcagccgccgccgcccgccggggcgcgtgacccggtgaccccggagcactgggcatccggacccccctcgcaggcgcagccgctattaaggcaggaggctaaagaggaggaggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagtagagacagggtttcaccgtgttagccaggatggtctcgatctcctgacctcgtgatccacccacctcggcctcccaaagtgctgggattacaggtgtgagccactgcacccggccaactttttatttttaacgtgtattacaccattaagcaagttccaacaatatcagagaattggtgtcattcttgctttaagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgaccgtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacatttttgcctgtatacatgcacattcgagttctggttgctgcatatttatttcagacagggtatgggcatttctcatacttttggataaaaggagattttggaatctatagagtatgtcaggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggctttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtttgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgctt

SEQ ID NO: 435775 - DNA, 3947 bp, Homo sapiens
cctaaggctcgcgtccgggccaggcgggtacccctagtactctctccccacacccccatggctctgccgcagccgccgccgcccgccggggcgcgtgacccggtgaccccggagcactgggcatccggacccccctcgcaggcgcagccgctattaaggcaggaggctaaagaggaggaggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgaccgtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacatttttgcctgtatacatgcacattcgagttctggttgctgcatatttatttcagacagggtatgggcatttctcatacttttggataaaaggagattttggaatctatagagtatgtcaggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggctttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtttgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgctt

SEQ ID NO: 435776 - DNA, 4234 bp, Homo sapiens
  misc_feature (4200)..(4200): n is a, c, g, or t
cctaaggctcgcgtccgggccaggcgggtacccctagtactctctccccacacccccatggctctgccgcagccgccgccgcccgccggggcgcgtgacccggtgaccccggagcactgggcatccggacccccctcgcaggcgcagccgctattaaggcaggaggctaaagaggaggaggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgaccgtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacatttttgcctgtatacatgcacattcgagttctggttgctgcatatttatttcagacagggtatgggcatttctcatacttttggataaaaggagattttggaatctatagagtatgtcaggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggctttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtttgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgcttatttttgtattggcaaagtatcaattaaactatatgtgttctttttcaaaaaacccatcccccccaacacaatctttctctcccccctcctcctacacccctctcacatctccaccctcttttatcctcttnacccccatttcgctctctcttttccctattctca

SEQ ID NO: 435777 - DNA, 2736 bp, Homo sapiens
caaggtcacatagtaagtggtacagcactagtaaaaatctgctgaaattctgtgttttttgaatgacatcaagctgatatctgaaatgactcttattaaagtcccaaagacatttttaactttgagttttgagtaatactattttgtatctttgacaactcttaatttaatcccaaatggggtaagtcaacattaaacaaagatgaaatggacactgctttcttaagataatctaatctatgcttctacactatagccctcagaaggacgacttttttctcttttagcaagatggcagttatagccagaggacagctcaggttggtgctttgctgggatttagttaatatgatgatgtatacatattttatattcagctctttacagtgaatgtaaaacaaatgtaatttaagggattagtaatatatacttgtacagtcattattgagtcttagccatttatactctgtcagagaaaatctgcctttgctgttcgtgtgtacctagaatgaaaacaattacttagaatgaaaccattttcttctccttttcaataggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggctttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtttgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgcttatttttgtattggcaaagtatcaattaaactatatgtgttctttttcaaaaa

SEQ ID NO: 435778 - DNA, 1107 bp, Homo sapiens
cctaaggctcgcgtccgggccaggcgggtacccctagtactctctccccacacccccatggctctgccgcagccgccgccgcccgccggggcgcgtgacccggtgaccccggagcactgggcatccggacccccctcgcaggcgcagccgctattaaggcaggaggctaaagaggaggaggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataaggtaaaacttgtctattcccttctgtagagtgttttagaagttaaccaactgaatagttacaggaggagtgtgtctctccagattgagtaggagctgaaaaaattttactttgattttcagaaaggttggggaaaaagagggatgaattgctttaatgaggaagatgacaaaaagaagtggtggctaagacattggcaagctttttattgtaataacttaaacttttagttttcagaaataataaattcttaccatggaaaaacttttaaatttccttagaaagaagacaaa

SEQ ID NO: 435779 - DNA, 435 bp, Homo sapiens
gatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactgtgagaaatttttacatatgtcagtagatggagactataatatcaattgctttaagccataagtcattataacatggttataaataatttgttttattgcagtcttagtaacttgtagttattgtgtataaagatacatctagaaattattttgctttctatcatctagttgaatatatacgtaagagttttggtatactctaagagagaaagaagttagggaagaggggaaattaaacttcatttactgagtgctaatcactgttaatatacattgtc

SEQ ID NO: 435780 - DNA, 541 bp, Homo sapiens
gattttaatgtttgaaagattgcacttgtttgcttttactatatgtggggtaaaatatattttctgttcacagtatatgaaaatatggagtaatttaaacagtaaataaacattctgtggatgcttatttttgtattggcaaagtatcaattaaactatatgtgttctttttcaaaaatgctggatccattcatgattggttcaaatatctaattatttcctcaacttaaatttgctttttaaattgcttaatatgtaggggtaggttaccaaatgatagttggataaggaatcatttagttatcagagcttcagagggtcatctgctttccaccaaggaagtttaagcattatggttcattagtgattttgcttgaagattttaaaaatgtacttattatttatttagcactggatttatgtgctactgatatacctccattaatagaggaatatttcttggacagagatgtgtgttctttccttttctctcttcttttgcccttacttaatcttttgacatttcccagatagacaattg

SEQ ID NO: 435781 - DNA, 4120 bp, Homo sapiens
cctaaggctcgcgtccgggccaggcgggtacccctagtactctctccccacacccccatggctctgccgcagccgccgccgcccgccggggcgcgtgacccggtgaccccggagcactgggcatccggacccccctcgcaggcgcagccgctattaaggcaggaggctaaagaggaggaggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgaccgtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacatttttgcctgtatacatgcacattcgagttctggttgctgcatatttatttcagacagggtatgggcatttctcatacttttggataaaaggagattttggaatctatagagtatgtcaggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggctttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtttgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgcttatttttgtattggcaaagtatcaattaaactatatgtgttctttttcaaaaa

SEQ ID NO: 435782 - DNA, 3911 bp, Homo sapiens
cctaaggctcgcgtccgggccaggcgggtacccctagtactctctccccacacccccatggctctgccgcagccgccgccgcccgccggggcgcgtgacccggtgaccccggagcactgggcatccggacccccctcgcaggcgcagccgctattaaggcaggaggctaaagaggaggaggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccaagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgaccgtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacatttttgcctgtatacatgcacattcgagttctggttgctgcatatttatttcagacagggtatgggcatttctcatacttttggataaaaggagattttggaatctatagagtatgtcaggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggctttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtttgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgctt

SEQ ID NO: 435783 - DNA, 4022 bp, Homo sapiens
  misc_feature (4003)..(4003): n is a, c, g, or t
cctaaggctcgcgtccgggccaggcgggtacccctagtactctctccccacacccccatggctctgccgcagccgccgccgcccgccggggcgcgtgacccggtgaccccggagcactgggcatccggacccccctcgcaggcgcagccgctattaaggcaggaggctaaagaggaggaggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgaccgtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacatttttgcctgtatacatgcacattcgagttctggttgctgcatatttatttcagacagggtatgggcatttctcatacttttggataaaaggagattttggaatctatagagtatgtcaggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggctttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtttgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaatgtttttgctttttgtttgatttttttttacaagctaactgttagaggtatacatttatttatctgttgtacagatcacatttgattctacgctagaagactgctcttcgtccttttacaacgggggggatacatatttttgttcccgcttttatatagcggcactaaacgacataacctttcgcgggcgctccttccngaggccaaccttacttctc

SEQ ID NO: 435784 - DNA, 2439 bp, Homo sapiens
cctaaggctcgcgtccgggccaggcgggtacccctagtactctctccccacacccccatggctctgccgcagccgccgccgcccgccggggcgcgtgacccggtgaccccggagcactgggcatccggacccccctcgcaggcgcagccgctattaaggcaggaggctaaagaggaggaggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgaccgtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacagtaagtatttggaatttaagttcagaaagtataggaagtgatgtcattttaatgtttctttaagggcaccagcttttttgtgttttataatctctaccagttatagacccttcttatttcccacttaatctttccgcctttccatttttctcctctttgagaaaatgtaattttcaaagcaaaattttttttaaaaaagataaggcaataattgctttgtatttgcttgggccttaatttttaacataatagaaatagctgatatctaagggtattattttatggccatcttattgaacagctaatttgaagttatcaggaaactttgaagaggccaggtgtagtggctcatgcctgtaatcctagcactttcggaggccgaggtgggtggatcacctgaggtcaggagttcaagaccagcctagccaacatggtgagaccctgtctctactaaaaatacaaaaactagccaggcatggcggtgcatgcctgtaatcccagctactcggaaagctgaggcaggagaaacacttgaacccaggggatagaggttgcaatgagccgatatttcaccactgtactccagcctgggttgcagagtgagactccgtctcaaaa

SEQ ID NO: 435785 - DNA, 905 bp, Homo sapiens
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttt

SEQ ID NO: 435786 - DNA, 783 bp, Homo sapiens
agagagagagagagagagagaggaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttt

SEQ ID NO: 435787 - DNA, 1178 bp, Homo sapiens
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttttatctgactgctgtgattatggtggggagaggagctagagatgggttcacttattgcacagaaatgtaatacatggcgttattattctaacataaaactttcagatgtagctgtttgattcaaagcctaggtggcttaccagcccaagtccccatgtttggactttcagctgactagctcatcttgggaatcatttggtcattcagcacatttaccaagtatttactatgtaggcatgttaaactccaataaaacatacagcattgaatcaga

SEQ ID NO: 435788 - DNA, 1695 bp, Homo sapiens
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttttatctgactgctgtgattatggtggggagaggagctagagatgggttcacttattgcacagaaatgtaatacatggcgttattattctaacataaaactttcagatgtagctgtttgattcaaagcctaggtggcttaccagcccaagtccccatgtttggactttcagctgactagctcatcttgggaatcatttggtcattcagcacatttaccaagtatttactatgtaggcatgttaaactccaataaaacatacagcattgaatcagaaaaaaaaaaaaaaaaaatttttttaaacgcatttccctaatagggagggaaattctgatccctggaagcacaggagagtgggacatggcctctttctcacctcctctcacctactcctctttgggagaaggaggaactcatctaatagatgagattagggaaaaggaatgagcatgttgggattgacttcatcaatatttgttcttttgccctgagaagtgcattctcgtttgtctgtggctgttcaattcagtggcaaggcattagcagcccaacttgcctaattcattccacatttttatttatttatttatttatttatttatttatttatttatttatttgagatggagtctcgctctgttgccaggctggagtcggacgcaacgggccacttggggaggcgccgccgccgtggccgctctccgcccccgccacggcacttgctcgggtggccaccgctgcaggaagctcgatagcggcgccgcggcgcttccaggtgggtccccgcctcccg

SEQ ID NO: 435789 - DNA, 1422 bp, Homo sapiens
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaacttttaaaaaaaaaaaaaaaaatttttttaaacgcatttccctaatagggagggaaattctgatccctggaagcacaggagagtgggacatggcctctttctcacctcctctcacctactcctctttgggagaaggaggaactcatctaatagatgagattagggaaaaggaatgagcatgttgggattgacttcatcaatatttgttcttttgccctgagaagtgcattctcgtttgtctgtggctgttcaattcagtggcaaggcattagcagcccaacttgcctaattcattccacatttttatttatttatttatttatttatttatttatttatttatttatttgagatggagtctcgctctgttgccaggctggagtcggacgcaacgggccacttggggaggcgccgccgccgtggccgctctccgcccccgccacggcacttgctcgggtggccaccgctgcaggaagctcgatagcggcgccgcggcgcttccaggtgggtccccgcctcccg

SEQ ID NO: 435790 - DNA, 897 bp, Homo sapiens
  misc_feature (837)..(837): n is a, c, g, or t
  misc_feature (861)..(861): n is a, c, g, or t
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaagccggcccttggtgggggacattgcaattcttgcngggggaagcccaattcaaaactcnttaaaaaaaaaaaagtgggcggccaattaaacttgg

SEQ ID NO: 435791 - DNA, 970 bp, Homo sapiens
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgcctactcagcaggaagacaatgaggatgaagacctttatgatgatccactgccatttaatgaataatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttt

SEQ ID NO: 435792 - DNA, 792 bp, Homo sapiens
gttaatgattatatttattgtaaatatttaatctgttattattttattagtcaatccattatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttt

SEQ ID NO: 435793 - DNA, 817 bp, Homo sapiens
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccactttcttgttgatttggagaggtcaaggccaggcccccacttggcttgaagggacattttcagacttttctttctgtcacttggagtgtctatgcctctcatatttccctaataaactcctcaactttt

SEQ ID NO: 435794 - DNA, 1124 bp, Homo sapiens
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagcctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttttatctgactgctgtgattatggtggggagaggagctagagatgggttcacttattgcacagaaatgtaatacatggcgttattattctaacataaaactttcagatgtagctgtttgattcaaagcctaggtggcttaccagcccaagtccccatgtttggactttcagctgactagctcatcttgggaatcatttggtcattcagcacatttaccaagtatttactatgtaggcatgttaaactccaataaaacatacagcattgaatcaga

SEQ ID NO: 435795 - DNA, 851 bp, Homo sapiens
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttt

SEQ ID NO: 435796 - DNA, 757 bp, Homo sapiens
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcagccaggcccccacttggcttgaagggacattttcagacttttctttctgtcacttggagtgtctatgcctctcatatttccctaataaactcctcaactttt

SEQ ID NO: 435797 - DNA, 984 bp, Homo sapiens
gctggtacggtcggaattgtgggatgacagcctgaacggagaatagagtacatgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttttatctgactgctgtgattatggtggggagaggagctagagatgggttcacttattgcacagaaatgtaatacatggcgttattattctaacataaaactttcagatgtagctgtttgattcaaagcctaggtggcttaccagcccaagtccccatgtttggactttcagctgactagctcatcttgggaatcatttggtcattcagcacatttaccaagtatttactatgtaggcatgttaaactccaataaaacatacagcattgaatcaga

SEQ ID NO: 435798 - DNA, 914 bp, Homo sapiens
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaagcatgagcttggcctaaagaggccactgggtggcaggagctgggtgtgtagaagctgctgaaaggttgggagcttggcttggggggtccacagtgaggcagatgctgggcctgaagaatctgctgtgaggcagatgttgggactgtagaggccgacgggaggcagaggctgtgccttggaggggtcaccaagatgcaggagctgggcctggagaggctgcaaagaagcatgagctgggcctggtgaggtcgacttgagaaagttcagggcctggagagaaggctgggaggcaggagctgggtctagagaggccatggcaacagggtct

SEQ ID NO: 435799 - DNA, 623 bp, Homo sapiens
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccctttgaacctttccttaaagttctcattggcattgccctggtttggggaacagcctatga

SEQ ID NO: 435800 - DNA, 909 bp, Homo sapiens
tagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgcctactcagcaggaagacaatgaggatgaagacctttatgatgatccactgccatttaatgaataatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccactttggggaaggggggcgctggcaaaacatgcctgatggtccaaaatttggtaccccattttgttgaagaacacagccctgttaagatacaaatttgtcgggatgccattcaacacatttagaagggagagttcaaaggttacaataacacactta

SEQ ID NO: 435801 - DNA, 152 bp, Homo sapiens
ctgtgacttcacagctatcttcttttctgctatttctcactgcctaggatctaaagatttttttttagacccctctaatcttttttaatttatctaaatgtcagttttcctttcctttcacaggtgacaaaaggtgagacactcacctagaa

SEQ ID NO: 435802 - DNA, 1431 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaag

SEQ ID NO: 435803 - DNA, 1560 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgggaaggggggtcctctaacgc

SEQ ID NO: 435804 - DNA, 2433 bp, Homo sapiens
ccctccccaaccctgccctcggccttgtcccgggatcgctccgtcgcacccaccatgatggaagacgacgggcagccccggactctacacacacaagctaagacatatggttctatcttcagaaaacaatatggtgtttagagcctaggtagcaattatatatttaaagacttggatctttagcttgactatttcataaccagagcagaaagaaagtgaagtgtagaagctataatttggaacgaataaagatgtcatttcaatgaactaccaagagatgatcttactagatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435805 - DNA, 2384 bp, Homo sapiens
ccctccccaaccctgccctcggccttgtcccgggatcgctccgtcgcacccaccatgatggaagacgacgggcagccccggactctacacacacaagctaagacatatggttctatcttcagaaaacaatatggtgtttagagcctagttcctacagttcctgttcttagaagacaaaatagactctaagatacgtaggtaacctttccagagatgtgacagaagtccttatacttcagttgttcagtcagattggaccctgtaaaagctgtaaaatgataacagagcaacccgatagcagaagggtcaactcttctgttggattttctgttttgcagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435806 - DNA, 2280 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcaacccgatagcagaagggtcaactcttctgttggattttctgttttgcagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435807 - DNA, 2605 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435808 - DNA, 2622 bp, Homo sapiens
ccctccccaaccctgccctcggccttgtcccgggatcgctccgtcgcacccaccatgatggaagacgacgggcagccccggactctacacacacaagctaagacatatggttctatcttcagaaaacaatatggtgtttagagcctagatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacagaggtaattcgatttttcatagcattctttaaggtttccatcttacatgtcacataaaagctttggaaactctgtaaaatgaacaataaaataaagcatatagctactttcagttgattgtatttcaaaattgattatttgcggtattaactgaatcttaatactttcttttcacaggtgtcaccaccccaataaacttagacaatgataaataacagagtcctattcacataagggtgcttacttagtttttctcttccttgtctcccactctttcttcatatacggtgtttcttatgtgttccctaaaacaatactttgctttttcctaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435809 - DNA, 3396 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatgtatgcctttttaattcctattttttcctctttttcaattttttaatatttcatatattttgtatcactaggcagaagacatttaactatttagagattgcatggtaaagtagttagtattgttacagtaatttatagaatcagtaaaccttagaggacactagtaaatagaatattagaaagggaaactgttgttcctattaatcttcaaatttgagcatttagtttagaaagcacaggctatttgattaggttgcatgtttattacatgtttttgtcctactgcttttttctaacaggtaaagaagcattagggagagttcaggaatggttgtagttaattagggctaactggaattttattttaaaaatgctcacaatacagtgtgtgtggttccttttagtttttattttgagggtggctcttacttccctcatttagctgtgcttcttttcacagggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacagaggtaattcgatttttcatagcattctttaaggtttccatcttacatgtcacataaaagctttggaaactctgtaaaatgaacaataaaataaagcatatagctactttcagttgattgtatttcaaaattgattatttgcggtattaactgaatcttaatactttcttttcacaggtgtcaccaccccaataaacttagacaatgataaataacagagtcctattcacataagggtgcttacttagtttttctcttccttgtctcccactctttcttcatatacggtgtttcttatgtgttccctaaaacaatactttgctttttcctaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435810 - DNA, 2545 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatggatgcccgggtagttaaagacatggcaactggaaaatccaaaggctatggttttgtatctttttataacaaactgaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435811 - DNA, 1824 bp, Homo sapiens
ccctccccaaccctgccctcggccttgtcccgggatcgctccgtcgcacccaccatgatggaagacgacgggcagccccggactctacacacacaagctaagacatatggttctatcttcagaaaacaatatggtgtttagagcctagatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacagaggtaattcgatttttcatagcattctttaaggtttccatcttacatgtcacataaaagctttggaaactctgtaaaatgaacaataaaataaagcatatagctactttcagttgattgtatttcaaaattgattatttgcggtattaactgaatcttaatactttcttttcacaggtgtcaccaccccaataaacttagacaatgataaataacagagtcctattcacataagggtgcttacttagtttttctcttccttgtctcccactctttcttcatatacggtgtttcttatgtgttccctaaaacaatactttgctttttcctaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaag

SEQ ID NO: 435812 - DNA, 1584 bp, Homo sapiens
ttttgttgatagagtggtttcctcctttgtaattcccctgcccagggccagcccatagctttattttcagatttcttcctttgagactgtttccaacatgaacttgtttttaaaatttcttatgtaatagatgatgtgttgaatcattcacaatttttaaaaaattagtttgcagatactcctcagacatcagtgtgttaagttgtggttatcttaaaaatatcaaagactaatactggaatatgtattctacacatatatcatttatttctttgatctttctatttgttgtaggtgtgttgatttctggttttctattctgtgattaggctctgcttgatttttgtgtaaatacatatgtgattttttttttcttgtgtttgctgaagattttttctttttcttccaagtcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435813 - DNA, 2326 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatgtatgcctttttaattcctattttttcctctttttcaattttttaatatttcatatattttgtatcactaggcagaagacatttaactatttagagattgcatggtaaagtagttagtattgttacagtaatttatagaatcagtaaaccttagaggacactagtaaatagaatattagaaagggaaactgttgttcctattaatcttcaaatttgagcatttagtttagaaagcacaggctatttgattaggttgcatgtttattacatgtttttgtcctactgcttttttctaacaggtaaagaagcattagggagagttcaggaatggttgtagttaattagggctaactggaattttattttaaaaatgctcacaatacagtgtgtgtggttccttttagtttttattttgagggtggctcttacttccctcatttagctgtgcttcttttcacagggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggtgtcaccaccccaataaacttagacaatgataaataacagagtcctattcacataagggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaag

SEQ ID NO: 435814 - DNA, 1862 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatgtatgcctttttaattcctattttttcctctttttcaattttttaatatttcatatattttgtatcactaggcagaagacatttaactatttagagattgcatggtaaagtagttagtattgttacagtaatttatagaatcagtaaaccttagaggacactagtaaatagaatattagaaagggaaactgttgttcctattaatcttcaaatttgagcatttagtttagaaagcacaggctatttgattaggttgcatgtttattacatgtttttgtcctactgcttttttctaacaggtaaagaagcattagggagagttcaggaatggttgtagttaattagggctaactggaattttattttaaaaatgctcacaatacagtgtgtgtggttccttttagtttttattttgagggtggctcttacttccctcatttagctgtgcttcttttcacagggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacagaggtaattcgatttttcatagcattctttaaggtttccatcttacatgtcacataaaagctttggaaactctgtaaaatgaacaataaaataaagcatatagctactttca

SEQ ID NO: 435815 - DNA, 634 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcgtaagtatcataatcagtactacactcagtcatgataggcagaattgtatatgattaacttgtaattgaattaagattttctttctctagttagtatggttttgttttgtttcttatttttcatttatttattttggtttgttttgagtagtggatgttgttgaaaatgttaatgtcatttcagtgtcttggggtctcgttttcatcta

SEQ ID NO: 435816 - DNA, 1048 bp, Homo sapiens
ccctccccaaccctgccctcggccttgtcccgggatcgctccgtcgcacccaccatgatggaagacgacgggcagccccggactctacacacacaagctaagacatatggttctatcttcagaaaacaatatggtgtttagagcctaggtagcaattatatatttaaagacttggatctttagcttgactatttcataaccagagcagaaagaaagtgaagtgtagaagctataatttggaacgaataaagatgtcatttcaatgaactaccaagagatgatcttactagatacgtaggtaacctttccagagatgtgacagaagtccttatacttcagttgttcagtcagattggaccctgtaaaagctgtaaaatgataacagagcaacccgatagcagaagggtcaactcttctgttggattttctgttttgcagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccagtaagtactcctgctgcattttactgtggaagagttctgaaattatccaggaggcattaccagcttaaataggtttttttttcctcctctagagttgccttaaaaaggttttagtggctgacttcttaagtatttgattaccaaatgctctgatttcagatcacttccatgtgtttgttggggatttgagtccagaaattacaacagaagatatcaaatcagcatttgccccctttggtaaaatatcgtaagtatcataatcagtactacactcagtcatgataggcagaattgtatatgattaacttgtaattgaattaagattttctttctctagttagtatggttttgttttgtttcttatttttcatttatttattttggtttgttttgagtagtggatgttgttgaaaatgttaatgtcatttcagtgtcttggggtctcgttttcatcta

SEQ ID NO: 435817 - DNA, 404 bp, Homo sapiens
gcattagggagagttcaggaatggttgtagttaattagggctaactggaattttattttaaaaatgctcacaatacagtgtgtgtggttccttttagtttttattttgagggtggctcttacttccctcatttagctgtgcttcttttcacagggatgcccgggtagttaaagacatggcaactggaaaatccaaaggctatggttttgtatctttttataacaaactggtacgttcttccatctcaatttatattttttaatactaaatttagtcattagttacttaatgtattgaatctgaaacttgaatatacttgaatgttaactacaaacacaacttttatgtaatgttatgtatgttttaataatagagtataatttcattcctctttcataaactcg

SEQ ID NO: 435818 - DNA, 2229 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435819 - DNA, 2175 bp, Homo sapiens
ctaaaaaaaaaagaaagaaagaaagaaagaaaatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435820 - DNA, 2484 bp, Homo sapiens
ccctccccaaccctgccctcggccttgtcccgggatcgctccgtcgcacccaccatgatggaagacgacgggcagccccggactctacacacacaagctaagacatatggttctatcttcagaaaacaatatggtgtttagagcctaggtagcaattatatatttaaagacttggatctttagcttgactatttcataaccagagcagaaagaaagtgaagtgtagaagctataatttggaacgaataaagatgtcatttcaatgaactaccaagagatgatcttactagatacgtaggtaacctttccagagatgtgacagaagtccttatacttcagttgttcagtcagattggaccctgtaaaagctgtaaaatgataacagagcaacccgatagcagaagggtcaactcttctgttggattttctgttttgcagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435821 - DNA, 3065 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatgtatgcctttttaattcctattttttcctctttttcaattttttaatatttcatatattttgtatcactaggcagaagacatttaactatttagagattgcatggtaaagtagttagtattgttacagtaatttatagaatcagtaaaccttagaggacactagtaaatagaatattagaaagggaaactgttgttcctattaatcttcaaatttgagcatttagtttagaaagcacaggctatttgattaggttgcatgtttattacatgtttttgtcctactgcttttttctaacaggtaaagaagcattagggagagttcaggaatggttgtagttaattagggctaactggaattttattttaaaaatgctcacaatacagtgtgtgtggttccttttagtttttattttgagggtggctcttacttccctcatttagctgtgcttcttttcacagggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435822 - DNA, 2297 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcctgcccaaactccaaaatgatggtagagaattgaccaagaaaaataaagaaatctgttaacaggccatggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435823 - DNA, 1795 bp, Homo sapiens
gtgaggtgactctacaggagctgtagctgtctcaggctatggtttcgtatctttatataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435824 - DNA, 1750 bp, Homo sapiens
gtgaggtgactctacaggagctgtagctgtctcaggctatggtttcgtatctttatataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacagccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435825 - DNA, 3417 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatgtatgcctttttaattcctattttttcctctttttcaattttttaatatttcatatattttgtatcactaggcagaagacatttaactatttagagattgcatggtaaagtagttagtattgttacagtaatttatagaatcagtaaaccttagaggacactagtaaatagaatattagaaagggaaactgttgttcctattaatcttcaaatttgagcatttagtttagaaagcacaggctatttgattaggttgcatgtttattacatgtttttgtcctactgcttttttctaacaggtaaagaagcattagggagagttcaggaatggttgtagttaattagggctaactggaattttattttaaaaatgctcacaatacagtgtgtgtggttccttttagtttttattttgagggtggctcttacttccctcatttagctgtgcttcttttcacagggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacagaggtaattcgatttttcatagcattctttaaggtttccatcttacatgtcacataaaagctttggaaactctgtaaaatgaacaataaaataaagcatatagctactttcagttgattgtatttcaaaattgattatttgcggtattaactgaatcttaatactttcttttcacaggtgtcaccaccccaataaacttagacaatgataaataacagagtcctattcacataagggtgcttacttagtttttctcttccttgtctcccactctttcttcatatacggtgtttcttatgtgttccctaaaacaatactttgctttttcctaggttgactatagtcaatggggccaatggagccaagtgtatggaaacccacaacagtatggacagtatatggcaaatgggtggcaagtaccgccttatggagtatacgggcaaccatggaatcaacaaggatttggagtagaattttttctttttcttccaagtcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttt

SEQ ID NO: 435826 - DNA, 2442 bp, Homo sapiens
ccctccccaaccctgccctcggccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatgtatgcctttttaattcctattttttcctctttttcaattttttaatatttcatatattttgtatcactaggcagaagacatttaactatttagagattgcatggtaaagtagttagtattgttacagtaatttatagaatcagtaaaccttagaggacactagtaaatagaatattagaaagggaaactgttgttcctattaatcttcaaatttgagcatttagtttagaaagcacaggctatttgattaggttgcatgtttattacatgtttttgtcctactgcttttttctaacaggtaaagaagcattagggagagttcaggaatggttgtagttaattagggctaactggaattttattttaaaaatgctcacaatacagtgtgtgtggttccttttagtttttattttgagggtggctcttacttccctcatttagctgtgcttcttttcacagggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacagaggtaattcgatttttcatagcattctttaaggtttccatcttacatgtcacataaaagctttggaaactctgtaaaatgaacaataaaataaagcatatagctactttcagttgattgtatttcaaaattgattatttgcggtattaactgaatcttaatactttcttttcacaggtgtcaccaccccaataaacttagacaatgataaataacagagtcctattcacataagggtgcttacttagtttttctcttccttgtctcccactctttcttcatatacggtgtttcttatgtgttccctaaaacaatactttgctttttcctaggttgactatagtcaatggggccaatggagccaagtgtatggaaacccacaacagtatggacagtatatggcaaatgggtggcaagtaccgccttatggagtatacgggcaaccatggaatcaacaaggatttggagtagagtaagttgtttgggtttttccagtatagaaacgtatggttctgacaaaataaataaaagtgtgttttcctagggagaatctattttaattatatacattgagctatttggcattatgagcattatagaaactaatctaacaaaatatgatttatgaggctaagaaattacttctcattacctaggtggaaaggggggattggggtaacatttagtgtgtc

SEQ ID NO: 435827 - DNA, 889 bp, Homo sapiens
ccctccccaaccctgccctcggccttgtcccgggatcgctccgtcgcacccaccatgatggaagacgacgggcagccccggactctacacacacaagctaagacatatggttctatcttcagaaaacaatatggtgtttagagcctaggtagcaattatatatttaaagacttggatctttagcttgactatttcataaccagagcagaaagaaagtgaagtgtagaagctataatttggaacgaataaagatgtcatttcaatgaactaccaagagatgatcttactagatacgtaggtaacctttccagagatgtgacagaagtccttatacttcagttgttcagtcagattggaccctgtaaaagctgtaaaatgataacagagcaacccgatagcagaagggtcaactcttctgttggattttctgttttgcagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcgtaagtatcataatcagtactacactcagtcatgataggcagaattgtatatgattaacttgtaattgaattaagattttctttctctagttagtatggttttgttttgtttcttatttttcatttatttattttggtttgttttgagtagtggatgttgttgaaaatgttaatgtcatttcagtgtcttggggtctcgttttcatcta

SEQ ID NO: 435828 - DNA, 562 bp, Homo sapiens
ctgcaggattcggcacgagctcgtgccgaattcggcacgtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 435829 - DNA, 290 bp, Homo sapiens
  misc_feature (36)..(36): n is a, c, g, or t
cgagctcggtacccttcatatccgcccttcatgtcnaggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcctcgacatgaagggatcctctagagtcgatcacaggc

SEQ ID NO: 435830 - DNA, 266 bp, Homo sapiens
ttgctttttaaagaaaaatgttagttcagttccaagtcatgtgggtaccaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 435831 - DNA, 6103 bp, Homo sapiens
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccacctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 435832 - DNA, 6049 bp, Homo sapiens
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccacctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 435833 - DNA, 6167 bp, Homo sapiens
  misc_feature (6109)..(6109): n is a, c, g, or t
  misc_feature (6129)..(6130): n is a, c, g, or t
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccacctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaaaaagcnttgcgtgatagacatcaccnncccactattcttagccagttgacctgtagctcctctg

SEQ ID NO: 435834 - DNA, 6066 bp, Homo sapiens
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccacctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttattacacatcttagtttagaatcacttttacattcctagacaaagagatgatac

SEQ ID NO: 435835 - DNA, 5665 bp, Homo sapiens
  misc_feature (5640)..(5640): n is a, c, g, or t
  misc_feature (5646)..(5646): n is a, c, g, or t
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccacctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttccctcatattttcttgagatcaaactttacttctttcttatttactaaggaatttgcctgtttgaataaggaacaaaacgctaaggtggggtagcctaagctggattttctgctggttacacgtgtctcttcacaccacatttcctcaaaggctaatctggaattctgtagggcttaaaaatatttcatgtaggcaaatctggggaattggaaaacttgcaggntaaccnggccggggtatgggtggac

SEQ ID NO: 435836 - DNA, 5419 bp, Homo sapiens
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccacctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcctcgacatgaagggatcctctagagtcgatcacaggc

SEQ ID NO: 435837 - DNA, 5571 bp, Homo sapiens
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccacctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagagcgctggatatgaattcatgtcggagctttcatcccccagttttacagatgagggaatagaggtttagggacatagagtttgttttatcatcaattcagtggtaccttcctcacatgttagttctaagaagctacacttggcagcagaggccacatttgctgaggaaaggcatgaagccctgacatgaa

SEQ ID NO: 435838 - DNA, 6045 bp, Homo sapiens
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttcatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccacctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 435839 - DNA, 1318 bp, Homo sapiens
  misc_feature (102)..(102): n is a, c, g, or t
tgccttatcatcttcagcacccctgagccctctgaagaagggattaagatggtccttggctttcagattaagtgataagtgcagattgataaaataatgatnagggtcaaacattcagacatttttatctgtaagatttttttcaggttgctaataaaaattcagaggggactgacaataaacacagaatttccttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 435840 - DNA, 1213 bp, Homo sapiens
cttatctagaggatcccgtgtatgcaacccccaatagacccccttttactcttcagccaaaaacacatatagctgctaatggcaattctgattcatctagagccaaaaacttgatgtgatttagcctgcattgtgcctagttctgggcaggcttgtcaacatttggaaataggaaagctggtgtatccattgaggaccctttaggcctaagagcccagtctgagaaccctggaatggaggagtggcatgaaagcactggacatgaattcatgtcgaggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 435841 - DNA, 974 bp, Homo sapiens
  misc_feature (36)..(36): n is a, c, g, or t
cgagctcggtacccttcatatccgcccttcatgtcnaggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 435842 - DNA, 307 bp, Homo sapiens
ggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggtaccatacccgtacccttccttaggcccttgccctgtcactgcttttgctttcatcaaacaacaacaaaaaacataaccatatgagggatgatgtctctcatcagttttggat

SEQ ID NO: 435843 - DNA, 1215 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435844 - DNA, 314 bp, Homo sapiens
atccgaattcggtccaaccggatgggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435845 - DNA, 1704 bp, Homo sapiens
gaattccgggtttgaaaaggagttctagggaagaagagagttagttagcacatcaatgggagcagggctcttaccccacgtggtgttacatatatattattttcatacatggtttctggctcataagttccttagcccttgctatagtcttttgtgttcggtcttaagggcaggactgtactcttccctcacctttctaattgtgcatcttaagaccttccccagagagggtggtgccctgtagttgtgggaaggaatgctggcatcatgaagcttccataaaaacccgagaaacgagcttctggatagctggacacatggaggtcctggagggtggagcccagggaggcatggaagctccacagcccttcccccataccttaccctatttcctctgtatcctttgtaatatcctttatgataaaccagcaaatgtgtgtaaatgtttccctaaggtctgtggccactccagcaaattaattgaacctaaagagggggtcgtgggaaccccaacttgaagccagtcagtcagaagttctggatgtccagacttcagactggtgtctgaaagggtggaggcagtcttggggaccgagcccccaatctatgggatctgacactatctccagtagtgttggaattgagtcaccagcgtgtccactggttagtgtgtgagaaactccctaccattggtcacagaagtcttcttctgtgttgatagttgtagtgtgacagcagaggaaaaacaaagtcagaaagagttttcccgaacacacccaatttctccattttactatccatttccacaaacactgactacaatagaagtataaaaattactccactgcatcattcagctttccatctctctcagacaccaagctgcagatccagttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435846 - DNA, 893 bp, Homo sapiens
atttgagcactgggtacaaatgtattttggatcaaagaaactccagtattcaaagataggaactgacaggattttaggtcactttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435847 - DNA, 1449 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccagttgtaggtcaccacctagaggggaggaagacctcgctttggagagtgggaataaaacgctcgtggaaaagggtacacacgtgagtgtctcattacacgaaaaacctcaggaagtaggatggacgtctttctggctgacctgaaacagaaagtgtaaaccaggcaagccataggtgggagctggagttctttttctaagagggctcttttccttctctctccttttctcaattaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435848 - DNA, 768 bp, Homo sapiens
  misc_feature (27)..(27): n is a, c, g, or t
gaccggcccctggttcgctcgggttangggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435849 - DNA, 1352 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaacagacgcaaaaaaaaaaaatgaggaaaagaacctaagaagagaacatatacgggtatttactattttactgttcttcagatttagtacttgtaaataaacacacacattaaggagagattaaacatttttgctaaaaaa

SEQ ID NO: 435850 - DNA, 1160 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435851 - DNA, 1141 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgcgtgattttgggggtgaagagtgggttgtgaggtgggccccatgttaacccctccactctttctttcaataaaacgcagttgcaaaca

SEQ ID NO: 435852 - DNA, 1377 bp, Homo sapiens
  misc_feature (911)..(911): n is a, c, g, or t
gaattccgggtttgaaaaggagttctagggaagaagagagttagttagcacatcaatgggagcagggctcttaccccacgtggtgttacatatatattattttcatacatggtttctggctcataagttccttagcccttgctatagtcttttgtgttcggtcttaagggcaggactgtactcttccctcacctttctaattgtgcatcttaagaccttccccagagagggtggtgccctgtagttgtgggaaggaatgctggcatcatgaagcttccataaaaacccgagaaacgagcttctggatagctggacacatggaggtcctggagggtggagcccagggaggcatggaagctccacagcccttcccccataccttaccctatttcctctgtatcctttgtaatatcctttatgataaaccagcaaatgtgtgtaaatgtttccctaaggtctgtggccactccagcaaattaattgaacctaaagagggggtcgtgggaaccccaacttgaagccagtcagtcagaagttctggatgtccagacttcagactggtgtctgaaagggtggaggcagtcttggggaccgagcccccaatctatgggatctgacactatctccagtagtgttggaattgagtcaccagcgtgtccactggttagtgtgtgagaaactccctaccattggtcacagaagtcttcttctgtgttgatagttgtagtgtgacagcagaggaaaaacaaagtcagaaagagttttcccgaacacacccaatttctccattttactatccatttccacaaacactgactacaatagaagtataaaaattactccactgcatcattcagctttccatctctctcagacaccaagctgcagatccaggcttttttgggaaagtnaggccaccatggctctggtagatgtccagaatgtttgtttccaggaaaaggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435853 - DNA, 1161 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggtgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435854 - DNA, 1238 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccagttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggtgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435855 - DNA, 1158 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccagttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435856 - DNA, 1255 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaacaaaaaaaaaaaaaaaaaaaaaaaaaaaaaaaaaaggggggg

SEQ ID NO: 435857 - DNA, 945 bp, Homo sapiens
atttgagcactgggtacaaatgtattttggatcaaagaaactccagtattcaaagataggaactgacaggattttaggtcactttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaacaaaaaaaaaaattctcaggccggaccgccaaagggccaacctcgagggggccg

SEQ ID NO: 435858 - DNA, 1292 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccagttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435859 - DNA, 759 bp, Homo sapiens
  misc_feature (21)..(21): n is a, c, g, or t
aactcaggggcgagctgcagntccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435860 - DNA, 1118 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435861 - DNA, 1181 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctaccaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435862 - DNA, 1220 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaaccaacacacaaccaaaaaccaacacaccacccccccccccccaacaaccccaaaaccactccccaggagagagagagatgaaaaaaaaacaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaaca

SEQ ID NO: 435863 - DNA, 8021 bp, Homo sapiens
ggccgcgggcgggcccgcccatctgtcagttacgggggctgcccggcgggcgggctggaggcgctcgcaggctgcctagtcgttcgctcgctctctctcgcgtgctccctctcgccgcctgtggggaagtcggggccgcccgagcggccgtcgccaccgcctcgccccgacctccttcccggtcccctcccggcccagtccctcccgcccgcgcaccccgagtagtgagtggccccgcgcaggtctggagagtcaccgcggcggcgccgggtggtggttaaaccatgttaaggaggattttacagaggactcctgggagagttggctctcaaggttctgatttagattcatcagcaactcctataaacacagtggacgtcaataatgaaagctcttcagagggtttcatatgtccccagtgtatgaaatctcttggatctgctgatgaacttttcaaacattatgaagctgttcatgatgctggtaatgactcaggtcatggaggagagtctaatcttgctttgaagcgagatgatgtaacactgctcagacaagaggtccaagacctacaggcttcacttaaggaagaaaaatggtactcggaagaattaaagaaggaattagaaaaatatcaagggctgcagcagcaagaggccaaacctgatgggttggtgactgattcatcagcagaactacagtctttggaacagcaattagaagaagcccaaacagaaaattttaatattaagcaaatgaaagacttatttgaacagaaagcagcccaacttgctactgaaattgcagatataaagtcaaagtatgatgaagaaaggagtcttcgagaagctgctgaacaaaaagtgacacgtctgacagaagaattaaacaaagaggcaactgtaattcaagatctgaagacggaactgcttcagagacctggtatagaagatgttgccgtgctaaagaaagaactggtccaagttcaaacactaatggataacatgaccttggaacgtgagcgagaatctgaaaaactcaaagatgaatgcaaaaaattgcagtcacaatatgctagctcagaggccacaataagccagctaaggagtgaacttgccaaaggcccccaggaagttgctgtatatgtacaggaactacaaaaactgaaaagttcagttaatgaattaacacaaaaaaatcagaccttgacagaaaacttgctgaaaaaagaacaagactatactaagttagaggagaaacataatgaagaatctgtgagtaaaaagaatattcaggcaacccttcatcaaaaagacctagattgtcaacagcttcagtcaagattgtctgcatctgaaacctcactgcatagaatacatgtagaactaagtgaaaaaggagaagctactcaaaagctcaaagaagaattatctgaggtagagaccaagtaccagcatctaaaggcggagtttaagcagctacaacaacagagagaagaaaaggagcagcatgggttacaactccaaagtgaaattaatcaattacatagcaaacttctggagacagagcgccaactaggggaagctcatggtaggctgaaggaacagagacagctttcaagtgaaaagttgatggataaagaacaacaagtggctgatttacaactcaaactttctcggttagaagagcagttgaaggaaaaagttacaaattctacagaattgcagcatcaattagataaaacaaagcaacagcatcaagaacaacaggctcttcagcaaagcaccacggcaaaacttcgagaagctcagaatgatttggaacaagttctacgtcaaattggcgataaggaccaaaagatccagaaccttgaagctttattacagaagagtaaagaaaatatttcattactagaaaaagaaagagaagatctttatgcaaaaattcaggctggtgaaggagagactgctgttcttaaccagttacaagaaaaaaaccatacactacaggagcaagtaactcaactaacagagaagctgaagaatcagtcagaaagtcataaacaagcccaggagaatttgcatgaccaggtacaagagcagaaggcacatcttagagctgcacaagaccgtgtcctttccctagaaactagtgtcaatgaattaaatagtcaattaaatgaaagcaaggagaaggtctcccagcttgacatacagattaaagccaaaaccgaactattactatcagcagaagcagcaaaaactgctcaaagagctgatcttcagaatcatttggacacagctcaaaatgcattacaagataaacagcaggagttaaataagattactactcagttggatcaggtcactgcaaagttacaagacaagcaagaacattgcagtcagctggaaagtcatcttaaagaatataaagagaaatacctctctttagaacagaaaaccgaagagctagaaggtcaaattaagaaactagaagctgatagtcttgaagttaaagcaagcaaggagcaggctttgcaagatctacaacagcaaagacagctgaacacagatttagagctcagagccacagaattgagtaaacaacttgaaatggagaaggaaatagtatccagtacaagattggatctacagaaaaaatctgaagcccttgaaagtatcaagcaaaagcttaccaagcaagaggaagaaaaacaaatcctgaaacaagattttgaaactttaagtcaagaaacaaagattcagcatgaggaattgaataacagaattcaaacaacagtaacagaactacaaaaagtgaaaatggagaaagaagctttaatgacagagctttctacagtaaaggacaaactatcaaaagtttctgattctttgaaaaactctaaaagtgaatttgaaaaggagaatcagaaaggaaaagccgctatattagacttggaaaaaacttgcaaagaattaaagcatcaacttcaagtgcagatggaaaacacacttaaggaacagaaggaactgaaaaagtcacttgaaaaagagaaggaggcttctcatcagttgaaattggaactcaattcaatgcaggaacaacttatacaggcccagaatactttaaaacaaaatgaaaaagaagagcaacaacttcaggggaacataaatgagctaaagcaatcaagtgaacagaagaaaaaacaaattgaagcactccaaggagagcttaaaattgctgttttacagaagacagagcttgagaataaactacagcagcagttaacacaggcagcccaggaacttgcagcagagaaagagaaaatatcagtattacaaaacaactatgaaaaaagtcaggaaactttcaaacagcttcaatctgatttctatgggagggaatctgaacttctagccaccaggcaagatcttaagtctgtagaagagaagctttctctagcacaggaggacttgatttcaaacagaaatcaaattggaaatcaaaataaattgattcaagaactgaagactgccaaggctacattggagcaggattcagcaaagaaagaacagcaattgcaggagcgatgtaaagcactacaagacattcagaaagaaaagtcactgaaagaaaaagaactggtaaatgagaagtctaaattggcagagatagaagaaattaaatgtagacaagaaaaagaaatcactaaactaaacgaagaactcaagtcccacaaactagaaagcataaaggagataacaaatcttaaagatgctaaacagcttctaattcagcagaaattagaacttcaaggaaaagcggactccctgaaggcagctgttgaacaggagaagagaaatcagcagatactaaaagaccaggtgaaaaaggaagaagaggagctgaagaaagaatttattgagaaagaagctaagttgcattccgaaataaaagaaaaggaagtaggaatgaagaagcatgaagaaaatgaggctaaacttaccatgcagattacagcattaaatgaaaacttaggcactgtgaagaaggagtggcaatctagtcaacggagagttagtgagcttgagaaacaaacggatgacttacggggtgaaattgcagtattagaagcaacggttcagaataatcaagatgaaaggagagcactactggaaagatgtcttaaaggagaaggtgaaatagaaaagcttcaaaccaaagtattagaattgcaaagaaagctggataatacaactgcagcagtgcaggagctgggcagagaaaaccaatcacttcagatcaaacatacacaagcgttgaatagaaagtgggccgaagacaatgaagtacaaaactgtatggcctgtgggaaaggcttttcagtaacagtgagacggcatcactgccgacagtgtggaaatatcttctgtgctgaatgttcagccaaaaatgccttaactccttcctccaagaagcctgttcgtgtctgtgatgcatgtttcaatgacttgcaaggataatgggttatcacaacttcagagtaatattacactaacattagatttttaataaatgtacttaatagaggtcttggactactatttggtttggacactggttgcaatactagaccaaataggaattagtatattttggaatgttatggatatcaagtaaaactcttctatttttgtgagacttgggcttatcatctttcattacttttttcccatttagcccctggaatagctttcatgccaagtttagaattagccaatgaaatgtaaataaactttggacagaaaatagcaatgtatttttttaatataatttcattattcacaaatgaagaatgcaattccatagcttacttctttctcctaaatttaatgtacaaaaatgtacatggatgatattatcacttgttgctgtttttgttgcacaatagcacattaattatattaaatattctctttgtgaagttatgcacagaactgtaacactttcctctgcctttttctcttatatgtgggttcatggttcagttgcattgttatgttatgaatttactacttgggtgttctaaatacagtttatcttaaaatatgtagtaatatgaattcaaaaatggtttttgttttaacaatattaattaaattttcttgggtggattttataaaaacctctgtaaaatcaatttgtttacttatagttatctggggttgtattgcaaagaatagggttaatttttctttttgtctttttctgtctctttcttaaactcccacgcattgtccatttagaatcttagaaagcttcttaccctcgctgtcagttggaggatgaataataaacattgtataatgttcttattctcggtttcttgtaagtgggaagtcttttgagatcagccttcatatcatacccttattttgtctctctagcatcttcaggaacctgagtttgctttttacatagatctgattttttcctttatttggtttaacattttcaagcatagatcagcttcatgtatttgttttataattttgcatcttaaagctagtaactaatattgctgtggtcttattggtgaaaacaaaatataaaatgataagaagacattaaatattttactttctatttcttaccctattgggaagaatttttaaaagttgtaaaattgacttaaagttaaaatggttctgaatttggtgttccatgtcaactgttcccagttttaattttaactttgcaaaaataatgttgtgaaattccctttaagtaactaacacctagaaatagagtatcaccaaaaacaaatgtatttaggaatcccagttacaataaaaactgaaacagcatggctaagcatcttaaggataattaagaaattagcttatttgtatgctgaacaatggaatcgaactttaatttagcatagtcttattaatttggaaaattgtaaaacatctcaagagagaagttattaatattggtttattaatctttctagagaagaagtgtagttatacattcattcagtgcaatcattttataacagtagttaatatttcatttataatagttcttaatatacatttgctttcaaatattctgaaatgaaattatattcatgctatacctacagtgtatgtaaactaaagagatcactacatatttgtttaattatttaaaaaaaaatttaagtaaaccctgttgtcattagctattaagaacattgattaagtccctggacttggataaacatatatccttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatgttcacagcaccactgttttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgagttaaaattaagtcttgctgggttagtgtacaataaactatacctacagacttttttttaatagaaagaagacaaagctgctggtataggatttgttcctttgaagaaaaaatgagggaaacaaacacaaaaacctcaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagtttttttaaaaaaatgcactttggctataaaaccatggatgatttgatccataagatttaaatgtgccaccattatagtattcctagacatgagcttgatgaatggtattctgtaattataacgtgccacacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaatgcagttgtgtatatgacattctgtaattccttgaactggatcatatattcataagttctgtagatacttatgcatgaacattttctcatttagttcttgggttcattatttgtattgtgtttactacttgtgatcatgtagttgtgccttactttgtgagaaaggttagctcagtaaatactgcaatttctaaactcagtgattggaaggttattaattataaatgtaactgataaagtacgtgacagcatttaaatctgtataaagaacaatggaaggatccttattgaattgttgcttttttttaatatgtttaaatattatattaaaaacatttctttctaaa

SEQ ID NO: 435864 - DNA, 8283 bp, Homo sapiens
ggccgcgggcgggcccgcccatctgtcagttacgggggctgcccggcgggcgggctggaggcgctcgcaggctgcctagtcgttcgctcgctctctctcgcgtgctccctctcgccgcctgtggggaagtcggggccgcccgagcggccgtcgccaccgcctcgccccgacctccttcccggtcccctcccggcccagtccctcccgcccgcgcaccccgagtagtgagtggccccgcgcaggtctggagagtcaccgcggcggcgccgggtggtggttaaaccatgttaaggaggattttacagaggactcctgggagagttggctctcaaggttctgatttagattcatcagcaactcctataaacacagtggacgtcaataatgaaagctcttcagagggtttcatatgtccccagtgtatgaaatctcttggatctgctgatgaacttttcaaacattatgaagctgttcatgatgctggtaatgactcaggtcatggaggagagtctaatcttgctttgaagcgagatgatgtaacactgctcagacaagaggtccaagacctacaggcttcacttaaggaagaaaaatggtactcggaagaattaaagaaggaattagaaaaatatcaagggctgcagcagcaagaggccaaacctgatgggttggtgactgattcatcagcagaactacagtctttggaacagcaattagaagaagcccaaacagaaaattttaatattaagcaaatgaaagacttatttgaacagaaagcagcccaacttgctactgaaattgcagatataaagtcaaagtatgatgaagaaaggagtcttcgagaagctgctgaacaaaaagtgacacgtctgacagaagaattaaacaaagaggcaactgtaattcaagatctgaagacggaactgcttcagagacctggtatagaagatgttgccgtgctaaagaaagaactggtccaagttcaaacactaatggataacatgaccttggaacgtgagcgagaatctgaaaaactcaaagatgaatgcaaaaaattgcagtcacaatatgctagctcagaggccacaataagccagctaaggagtgaacttgccaaaggcccccaggaagttgctgtatatgtacaggaactacaaaaactgaaaagttcagttaatgaattaacacaaaaaaatcagaccttgacagaaaacttgctgaaaaaagaacaagactatactaagttagaggagaaacataatgaagaatctgtgagtaaaaagaatattcaggcaacccttcatcaaaaagacctagattgtcaacagcttcagtcaagattgtctgcatctgaaacctcactgcatagaatacatgtagaactaagtgaaaaaggagaagctactcaaaagctcaaagaagaattatctgaggtagagaccaagtaccagcatctaaaggcggagtttaagcagctacaacaacagagagaagaaaaggagcagcatgggttacaactccaaagtgaaattaatcaattacatagcaaacttctggagacagagcgccaactaggggaagctcatggtaggctgaaggaacagagacagctttcaagtgaaaagttgatggataaagaacaacaagtggctgatttacaactcaaactttctcggttagaagagcagttgaaggaaaaagttacaaattctacagaattgcagcatcaattagataaaacaaagcaacagcatcaagaacaacaggctcttcagcaaagcaccacggcaaaacttcgagaagctcagaatgatttggaacaagttctacgtcaaattggcgataaggaccaaaagatccagaaccttgaagctttattacagaagagtaaagaaaatatttcattactagaaaaagaaagagaagatctttatgcaaaaattcaggctggtgaaggagagactgctgttcttaaccagttacaagaaaaaaaccatacactacaggagcaagtaactcaactaacagagaagctgaagaatcagtcagaaagtcataaacaagcccaggagaatttgcatgaccaggtacaagagcagaaggcacatcttagagctgcacaagaccgtgtcctttccctagaaactagtgtcaatgaattaaatagtcaattaaatgaaagcaaggagaaggtctcccagcttgacatacagattaaagccaaaaccgaactattactatcagcagaagcagcaaaaactgctcaaagagctgatcttcagaatcatttggacacagctcaaaatgcattacaagataaacagcaggagttaaataagattactactcagttggatcaggtcactgcaaagttacaagacaagcaagaacattgcagtcagctggaaagtcatcttaaagaatataaagagaaatacctctctttagaacagaaaaccgaagagctagaaggtcaaattaagaaactagaagctgatagtcttgaagttaaagcaagcaaggagcaggctttgcaagatctacaacagcaaagacagctgaacacagatttagagctcagagccacagaattgagtaaacaacttgaaatggagaaggaaatagtatccagtacaagattggatctacagaaaaaatctgaagcccttgaaagtatcaagcaaaagcttaccaagcaagaggaagaaaaacaaatcctgaaacaagattttgaaactttaagtcaagaaacaaagattcagcatgaggaattgaataacagaattcaaacaacagtaacagaactacaaaaagtgaaaatggagaaagaagctttaatgacagagctttctacagtaaaggacaaactatcaaaagtttctgattctttgaaaaactctaaaagtgaatttgaaaaggagaatcagaaaggaaaagccgctatattagacttggaaaaaacttgcaaagaattaaagcatcaacttcaagtgcagatggaaaacacacttaaggaacagaaggaactgaaaaagtcacttgaaaaagagaaggaggcttctcatcagttgaaattggaactcaattcaatgcaggaacaacttatacaggcccagaatactttaaaacaaaatgaaaaagaagagcaacaacttcaggggaacataaatgagctaaagcaatcaagtgaacagaagaaaaaacaaattgaagcactccaaggagagcttaaaattgctgttttacagaagacagagcttgagaataaactacagcagcagttaacacaggcagcccaggaacttgcagcagagaaagagaaaatatcagtattacaaaacaactatgaaaaaagtcaggaaactttcaaacagcttcaatctgatttctatgggagggaatctgaacttctagccaccaggcaagatcttaagtctgtagaagagaagctttctctagcacaggaggacttgatttcaaacagaaatcaaattggaaatcaaaataaattgattcaagaactgaagactgccaaggctacattggagcaggattcagcaaagaaagaacagcaattgcaggagcgatgtaaagcactacaagacattcagaaagaaaagtcactgaaagaaaaagaactggtaaatgagaagtctaaattggcagagatagaagaaattaaatgtagacaagaaaaagaaatcactaaactaaacgaagaactcaagtcccacaaactagaaagcataaaggagataacaaatcttaaagatgctaaacagcttctaattcagcagaaattagaacttcaaggaaaagcggactccctgaaggcagctgttgaacaggagaagagaaatcagcagatactaaaagaccaggtgaaaaaggaagaagaggagctgaagaaagaatttattgagaaagaagctaagttgcattccgaaataaaagaaaaggaagtaggaatgaagaagcatgaagaaaatgaggctaaacttaccatgcagattacagcattaaatgaaaacttaggcactgtgaagaaggagtggcaatctagtcaacggagagttagtgagcttgagaaacaaacggatgacttacggggtgaaattgcagtattagaagcaacggttcagaataatcaagatgaaaggagagcactactggaaagatgtcttaaaggagaaggtgaaatagaaaagcttcaaaccaaagtattagaattgcaaagaaagctggataatacaactgcagcagtgcaggagctgggcagagaaaaccaatcacttcagatcaaacatacacaagcgttgaatagaaagtgggccgaagacaatgaagtacaaaactgtatggcctgtgggaaaggcttttcagtaacagtgagacggcatcactgccgacagtgtggaaatatcttctgtgctgaatgttcagccaaaaatgccttaactccttcctccaagaagcctgttcgtgtctgtgatgcatgtttcaatgacttgcaaggataatgggttatcacaacttcagagtaatattacactaacattagatttttaataaatgtacttaatagaggtcttggactactatttggtttggacactggttgcaatactagaccaaataggaattagtatattttggaatgttatggatatcaagtaaaactcttctatttttgtgagacttgggcttatcatctttcattacttttttcccatttagcccctggaatagctttcatgccaagtttagaattagccaatgaaatgtaaataaactttggacagaaaatagcaatgtatttttttaatataatttcattattcacaaatgaagaatgcaattccatagcttacttctttctcctaaatttaatgtacaaaaatgtacatggatgatattatcacttgttgctgtttttgttgcacaatagcacattaattatattaaatattctctttgtgaagttatgcacagaactgtaacactttcctctgcctttttctcttatatgtgggttcatggttcagttgcattgttatgttatgaatttactacttgggtgttctaaatacagtttatcttaaaatatgtagtaatatgaattcaaaaatggtttttgttttaacaatattaattaaattttcttgggtggattttataaaaacctctgtaaaatcaatttgtttacttatagttatctggggttgtattgcaaagaatagggttaatttttctttttgtctttttctgtctctttcttaaactcccacgcattgtccatttagaatcttagaaagcttcttaccctcgctgtcagttggaggatgaataataaacattgtataatgttcttattctcggtttcttgtaagtgggaagtcttttgagatcagccttcatatcatacccttattttgtctctctagcatcttcaggaacctgagtttgctttttacatagatctgattttttcctttatttggtttaacattttcaagcatagatcagcttcatgtatttgttttataattttgcatcttaaagctagtaactaatattgctgtggtcttattggtgaaaacaaaatataaaatgataagaagacattaaatattttactttctatttcttaccctattgggaagaatttttaaaagttgtaaaattgacttaaagttaaaatggttctgaatttggtgttccatgtcaactgttcccagttttaattttaactttgcaaaaataatgttgtgaaattccctttaagtaactaacacctagaaatagagtatcaccaaaaacaaatgtatttaggaatcccagttacaataaaaactgaaacagcatggctaagcatcttaaggataattaagaaattagcttatttgtatgctgaacaatggaatcgaactttaatttagcatagtcttattaatttggaaaattgtaaaacatctcaagagagaagttattaatattggtttattaatctttctagagaagaagtgtagttatacattcattcagtgcaatcattttataacagtagttaatatttcatttataatagttcttaatatacatttgctttcaaatattctgaaatgaaattatattcatgctatacctacagtgtatgtaaactaaagagatcactacatatttgtttaattatttaaaaaaaaatttaagtaaaccctgttgtcattagctattaagaacattgattaagtccctggacttggataaacatatatccttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatgttcacagcaccactgttttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgagttaaaattaagtcttgctgggttagtgtacaataaactatacctacagacttttttttaatagaaagaagacaaagctgctggtataggatttgttcctttgaagaaaaaatgagggaaacaaacacaaaaacctcaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagtttttttaaaaaaatgcactttggctataaaaccatggatgatttgatccataagatttaaatgtgccaccattatagtattcctagacatgagcttgatgaatggtattctgtaattataacgtgccacacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaatgcagttgtgtatatgacattctgtaattccttgaactggatcatatattcataagttctgtagatacttatgcatgaacattttctcatttagttcttgggttcattatttgtattgtgtttactacttgtgatcatgtagttgtgccttactttgtgagaaaggttagctcagtaaatactgcaatttctaaactcagtgattggaaggttattaattataaatgtaactgataaagtacgtgacagcatttaaatctgtataaagaacaatggaaggatccttattgaattgttgcttttttttaatatgtttaaatattatattaaaaacatttctttctaaaaaacgccagaagaaaagacaacacctttgtgggcctaggccctgagagaagttgatgaacacaagtagttgaggcgccgcgcgcccagatggcaactgagaaaggtgccaaagggggctccgagagagacgcgcgcaacaaaaggggtgaggactccaccaaaaaaaagccccgcgagacacagagcttttagaaaacatccaaaggagcatgacaagcacagaggagacacacaaaggaggtcacagagagcgagataatc

SEQ ID NO: 435865 - DNA, 8548 bp, Homo sapiens
ggccgcgggcgggcccgcccatctgtcagttacgggggctgcccggcgggcgggctggaggcgctcgcaggctgcctagtcgttcgctcgctctctctcgcgtgctccctctcgccgcctgtggggaagtcggggccgcccgagcggccgtcgccaccgcctcgccccgacctccttcccggtcccctcccggcccagtccctcccgcccgcgcaccccgagtagtgagtggccccgcgcaggtctggagagtcaccgcggcggcgccgggtggtggttaaaccatgttaaggaggattttacagaggactcctgggagagttggctctcaaggttctgatttagattcatcagcaactcctataaacacagtggacgtcaataatgaaagctcttcagagggtttcatatgtccccagtgtatgaaatctcttggatctgctgatgaacttttcaaacattatgaagctgttcatgatgctggtaatgactcaggtcatggaggagagtctaatcttgctttgaagcgagatgatgtaacactgctcagacaagaggtccaagacctacaggcttcacttaaggaagaaaaatggtactcggaagaattaaagaaggaattagaaaaatatcaagggctgcagcagcaagaggccaaacctgatgggttggtgactgattcatcagcagaactacagtctttggaacagcaattagaagaagcccaaacagaaaattttaatattaagcaaatgaaagacttatttgaacagaaagcagcccaacttgctactgaaattgcagatataaagtcaaagtatgatgaagaaaggagtcttcgagaagctgctgaacaaaaagtgacacgtctgacagaagaattaaacaaagaggcaactgtaattcaagatctgaagacggaactgcttcagagacctggtatagaagatgttgccgtgctaaagaaagaactggtccaagttcaaacactaatggataacatgaccttggaacgtgagcgagaatctgaaaaactcaaagatgaatgcaaaaaattgcagtcacaatatgctagctcagaggccacaataagccagctaaggagtgaacttgccaaaggcccccaggaagttgctgtatatgtacaggaactacaaaaactgaaaagttcagttaatgaattaacacaaaaaaatcagaccttgacagaaaacttgctgaaaaaagaacaagactatactaagttagaggagaaacataatgaagaatctgtgagtaaaaagaatattcaggcaacccttcatcaaaaagacctagattgtcaacagcttcagtcaagattgtctgcatctgaaacctcactgcatagaatacatgtagaactaagtgaaaaaggagaagctactcaaaagctcaaagaagaattatctgaggtagagaccaagtaccagcatctaaaggcggagtttaagcagctacaacaacagagagaagaaaaggagcagcatgggttacaactccaaagtgaaattaatcaattacatagcaaacttctggagacagagcgccaactaggggaagctcatggtaggctgaaggaacagagacagctttcaagtgaaaagttgatggataaagaacaacaagtggctgatttacaactcaaactttctcggttagaagagcagttgaaggaaaaagttacaaattctacagaattgcagcatcaattagataaaacaaagcaacagcatcaagaacaacaggctcttcagcaaagcaccacggcaaaacttcgagaagctcagaatgatttggaacaagttctacgtcaaattggcgataaggaccaaaagatccagaaccttgaagctttattacagaagagtaaagaaaatatttcattactagaaaaagaaagagaagatctttatgcaaaaattcaggctggtgaaggagagactgctgttcttaaccagttacaagaaaaaaaccatacactacaggagcaagtaactcaactaacagagaagctgaagaatcagtcagaaagtcataaacaagcccaggagaatttgcatgaccaggtacaagagcagaaggcacatcttagagctgcacaagaccgtgtcctttccctagaaactagtgtcaatgaattaaatagtcaattaaatgaaagcaaggagaaggtctcccagcttgacatacagattaaagccaaaaccgaactattactatcagcagaagcagcaaaaactgctcaaagagctgatcttcagaatcatttggacacagctcaaaatgcattacaagataaacagcaggagttaaataagattactactcagttggatcaggtcactgcaaagttacaagacaagcaagaacattgcagtcagctggaaagtcatcttaaagaatataaagagaaatacctctctttagaacagaaaaccgaagagctagaaggtcaaattaagaaactagaagctgatagtcttgaagttaaagcaagcaaggagcaggctttgcaagatctacaacagcaaagacagctgaacacagatttagagctcagagccacagaattgagtaaacaacttgaaatggagaaggaaatagtatccagtacaagattggatctacagaaaaaatctgaagcccttgaaagtatcaagcaaaagcttaccaagcaagaggaagaaaaacaaatcctgaaacaagattttgaaactttaagtcaagaaacaaagattcagcatgaggaattgaataacagaattcaaacaacagtaacagaactacaaaaagtgaaaatggagaaagaagctttaatgacagagctttctacagtaaaggacaaactatcaaaagtttctgattctttgaaaaactctaaaagtgaatttgaaaaggagaatcagaaaggaaaagccgctatattagacttggaaaaaacttgcaaagaattaaagcatcaacttcaagtgcagatggaaaacacacttaaggaacagaaggaactgaaaaagtcacttgaaaaagagaaggaggcttctcatcagttgaaattggaactcaattcaatgcaggaacaacttatacaggcccagaatactttaaaacaaaatgaaaaagaagagcaacaacttcaggggaacataaatgagctaaagcaatcaagtgaacagaagaaaaaacaaattgaagcactccaaggagagcttaaaattgctgttttacagaagacagagcttgagaataaactacagcagcagttaacacaggcagcccaggaacttgcagcagagaaagagaaaatatcagtattacaaaacaactatgaaaaaagtcaggaaactttcaaacagcttcaatctgatttctatgggagggaatctgaacttctagccaccaggcaagatcttaagtctgtagaagagaagctttctctagcacaggaggacttgatttcaaacagaaatcaaattggaaatcaaaataaattgattcaagaactgaagactgccaaggctacattggagcaggattcagcaaagaaagaacagcaattgcaggagcgatgtaaagcactacaagacattcagaaagaaaagtcactgaaagaaaaagaactggtaaatgagaagtctaaattggcagagatagaagaaattaaatgtagacaagaaaaagaaatcactaaactaaacgaagaactcaagtcccacaaactagaaagcataaaggagataacaaatcttaaagatgctaaacagcttctaattcagcagaaattagaacttcaaggaaaagcggactccctgaaggcagctgttgaacaggagaagagaaatcagcagatactaaaagaccaggtgaaaaaggaagaagaggagctgaagaaagaatttattgagaaagaagctaagttgcattccgaaataaaagaaaaggaagtaggaatgaagaagcatgaagaaaatgaggctaaacttaccatgcagattacagcattaaatgaaaacttaggcactgtgaagaaggagtggcaatctagtcaacggagagttagtgagcttgagaaacaaacggatgacttacggggtgaaattgcagtattagaagcaacggttcagaataatcaagatgaaaggagagcactactggaaagatgtcttaaaggagaaggtgaaatagaaaagcttcaaaccaaagtattagaattgcaaagaaagctggataatacaactgcagcagtgcaggagctgggcagagaaaaccaatcacttcagatcaaacatacacaagcgttgaatagaaagtgggccgaagacaatgaagtacaaaactgtatggcctgtgggaaaggcttttcagtaacagtgagacggcatcactgccgacagtgtggaaatatcttctgtgctgaatgttcagccaaaaatgccttaactccttcctccaagaagcctgttcgtgtctgtgatgcatgtttcaatgacttgcaaggataatgggttatcacaacttcagagtaatattacactaacattagatttttaataaatgtacttaatagaggtcttggactactatttggtttggacactggttgcaatactagaccaaataggaattagtatattttggaatgttatggatatcaagtaaaactcttctatttttgtgagacttgggcttatcatctttcattacttttttcccatttagcccctggaatagctttcatgccaagtttagaattagccaatgaaatgtaaataaactttggacagaaaatagcaatgtatttttttaatataatttcattattcacaaatgaagaatgcaattccatagcttacttctttctcctaaatttaatgtacaaaaatgtacatggatgatattatcacttgttgctgtttttgttgcacaatagcacattaattatattaaatattctctttgtgaagttatgcacagaactgtaacactttcctctgcctttttctcttatatgtgggttcatggttcagttgcattgttatgttatgaatttactacttgggtgttctaaatacagtttatcttaaaatatgtagtaatatgaattcaaaaatggtttttgttttaacaatattaattaaattttcttgggtggattttataaaaacctctgtaaaatcaatttgtttacttatagttatctggggttgtattgcaaagaatagggttaatttttctttttgtctttttctgtctctttcttaaactcccacgcattgtccatttagaatcttagaaagcttcttaccctcgctgtcagttggaggatgaataataaacattgtataatgttcttattctcggtttcttgtaagtgggaagtcttttgagatcagccttcatatcatacccttattttgtctctctagcatcttcaggaacctgagtttgctttttacatagatctgattttttcctttatttggtttaacattttcaagcatagatcagcttcatgtatttgttttataattttgcatcttaaagctagtaactaatattgctgtggtcttattggtgaaaacaaaatataaaatgataagaagacattaaatattttactttctatttcttaccctattgggaagaatttttaaaagttgtaaaattgacttaaagttaaaatggttctgaatttggtgttccatgtcaactgttcccagttttaattttaactttgcaaaaataatgttgtgaaattccctttaagtaactaacacctagaaatagagtatcaccaaaaacaaatgtatttaggaatcccagttacaataaaaactgaaacagcatggctaagcatcttaaggataattaagaaattagcttatttgtatgctgaacaatggaatcgaactttaatttagcatagtcttattaatttggaaaattgtaaaacatctcaagagagaagttattaatattggtttattaatctttctagagaagaagtgtagttatacattcattcagtgcaatcattttataacagtagttaatatttcatttataatagttcttaatatacatttgctttcaaatattctgaaatgaaattatattcatgctatacctacagtgtatgtaaactaaagagatcactacatatttgtttaattatttaaaaaaaaatttaagtaaaccctgttgtcattagctattaagaacattgattaagtccctggacttggataaacatatatccttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatgttcacagcaccactgttttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgagttaaaattaagtcttgctgggttagtgtacaataaactatacctacagacttttttttaatagaaagaagacaaagctgctggtataggatttgttcctttgaagaaaaaatgagggaaacaaacacaaaaacctcaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagtttttttaaaaaaatgcactttggctataaaaccatggatgatttgatccataagatttaaatgtgccaccattatagtattcctagacatgagcttgatgaatggtattctgtaattataacgtgccacacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaatgcagttgtgtatatgacattctgtaattccttgaactggatcatatattcataagttctgtagatacttatgcatgaacattttctcatttagttcttgggttcattatttgtattgtgtttactacttgtgatcatgtagttgtgccttactttgtgagaaaggttagctcagtaaatactgcaatttctaaactcagtgattggaaggttattaattataaatgtaactgataaagtacgtgacagcatttaaatctgtataaagaacaatggaaggatccttattgaattgttgcttttttttaatatgtttaaatattatattaaaaacatttctttctaaactagttgtattctgtgactataaattgttttgtctaacaaaagagagaacactgtattaaccattttgcattaatttatttacagaatattaggactttgcacttggatatagacagtggtgttttaatgttgttcaatttcgaatagtaattaaattcctgatctcaagagaaattattaatgccattttgccttagacattccatttaatattgtagagaattaacaaaactaaaaacaaatataaaaaatatgtaattaaccccttatttcattgtgtgtctgcatttaatacccagatgaccatttaaagatacttaaaacattatttatttatttatttatttatttttctccctcccctccccaaagatactttttggaaggcccaatgtgccattgttttttgctattttttcttcctgggagccacggttctagaatggtttttgttctgacccccgtgatcccttcattcgaatgtgcttcattctaaaccctccaaagagtttaatgtgcatatcct

SEQ ID NO: 435866 - DNA, 7967 bp, Homo sapiens
ggccgcgggcgggcccgcccatctgtcagttacgggggctgcccggcgggcgggctggaggcgctcgcaggctgcctagtcgttcgctcgctctctctcgcgtgctccctctcgccgcctgtggggaagtcggggccgcccgagcggccgtcgccaccgcctcgccccgacctccttcccggtcccctcccggcccagtccctcccgcccgcgcaccccgagtagtgagtggccccgcgcaggtctggagagtcaccgcggcggcgccgggtggtggttaaaccatgttaaggaggattttacagaggactcctgggagagttggctctcaaggttctgatttagattcatcagcaactcctataaacacagtggacgtcaataatgaaagctcttcagagggtttcatatgtccccagtgtatgaaatctcttggatctgctgatgaacttttcaaacattatgaagctgttcatgatgctggtaatgactcaggtcatggaggagagtctaatcttgctttgaagcgagatgatgtaacactgctcagacaagaggtccaagacctacaggcttcacttaaggaagaaaaatggtactcggaagaattaaagaaggaattagaaaaatatcaagggctgcagcagcaagaggccaaacctgatgggttggtgactgattcatcagcagaactacagtctttggaacagcaattagaagaagcccaaacagaaaattttaatattaagcaaatgaaagacttatttgaacagaaagcagcccaacttgctactgaaattgcagatataaagtcaaagtatgatgaagaaaggagtcttcgagaagctgctgaacaaaaagtgacacgtctgacagaagaattaaacaaagaggcaactgtaattcaagatctgaagacggaactgcttcagagacctggtatagaagatgttgccgtgctaaagaaagaactggtccaagttcaaacactaatggataacatgaccttggaacgtgagcgagaatctgaaaaactcaaagatgaatgcaaaaaattgcagtcacaatatgctagctcagaggccacaataagccagctaaggagtgaacttgccaaaggcccccaggaagttgctgtatatgtacaggaactacaaaaactgaaaagttcagttaatgaattaacacaaaaaaatcagaccttgacagaaaacttgctgaaaaaagaacaagactatactaagttagaggagaaacataatgaagaatctgtgagtaaaaagaatattcaggcaacccttcatcaaaaagacctagattgtcaacagcttcagtcaagattgtctgcatctgaaacctcactgcatagaatacatgtagaactaagtgaaaaaggagaagctactcaaaagctcaaagaagaattatctgaggtagagaccaagtaccagcatctaaaggcggagtttaagcagctacaacaacagagagaagaaaaggagcagcatgggttacaactccaaagtgaaattaatcaattacatagcaaacttctggagacagagcgccaactaggggaagctcatggtaggctgaaggaacagagacagctttcaagtgaaaagttgatggataaagaacaacaagtggctgatttacaactcaaactttctcggttagaagagcagttgaaggaaaaagttacaaattctacagaattgcagcatcaattagataaaacaaagcaacagcatcaagaacaacaggctcttcagcaaagcaccacggcaaaacttcgagaagctcagaatgatttggaacaagttctacgtcaaattggcgataaggaccaaaagatccagaaccttgaagctttattacagaagagtaaagaaaatatttcattactagaaaaagaaagagaagatctttatgcaaaaattcaggctggtgaaggagagactgctgttcttaaccagttacaagaaaaaaaccatacactacaggagcaagtaactcaactaacagagaagctgaagaatcagtcagaaagtcataaacaagcccaggagaatttgcatgaccaggtacaagagcagaaggcacatcttagagctgcacaagaccgtgtcctttccctagaaactagtgtcaatgaattaaatagtcaattaaatgaaagcaaggagaaggtctcccagcttgacatacagattaaagccaaaaccgaactattactatcagcagaagcagcaaaaactgctcaaagagctgatcttcagaatcatttggacacagctcaaaatgcattacaagataaacagcaggagttaaataagattactactcagttggatcaggtcactgcaaagttacaagacaagcaagaacattgcagtcagctggaaagtcatcttaaagaatataaagagaaatacctctctttagaacagaaaaccgaagagctagaaggtcaaattaagaaactagaagctgatagtcttgaagttaaagcaagcaaggagcaggctttgcaagatctacaacagcaaagacagctgaacacagatttagagctcagagccacagaattgagtaaacaacttgaaatggagaaggaaatagtatccagtacaagattggatctacagaaaaaatctgaagcccttgaaagtatcaagcaaaagcttaccaagcaagaggaagaaaaacaaatcctgaaacaagattttgaaactttaagtcaagaaacaaagattcagcatgaggaattgaataacagaattcaaacaacagtaacagaactacaaaaagtgaaaatggagaaagaagctttaatgacagagctttctacagtaaaggacaaactatcaaaagtttctgattctttgaaaaactctaaaagtgaatttgaaaaggagaatcagaaaggaaaagccgctatattagacttggaaaaaacttgcaaagaattaaagcatcaacttcaagtgcagatggaaaacacacttaaggaacagaaggaactgaaaaagtcacttgaaaaagagaaggaggcttctcatcagttgaaattggaactcaattcaatgcaggaacaacttatacaggcccagaatactttaaaacaaaatgaaaaagaagagcaacaacttcaggggaacataaatgagctaaagcaatcaagtgaacagaagaaaaaacaaattgaagcactccaaggagagcttaaaattgctgttttacagaagacagagcttgagaataaactacagcagcagttaacacaggcagcccaggaacttgcagcagagaaagagaaaatatcagtattacaaaacaactatgaaaaaagtcaggaaactttcaaacagcttcaatctgatttctatgggagggaatctgaacttctagccaccaggcaagatcttaagtctgtagaagagaagctttctctagcacaggaggacttgatttcaaacagaaatcaaattggaaatcaaaataaattgattcaagaactgaagactgccaaggctacattggagcaggattcagcaaagaaagaacagcaattgcaggagcgatgtaaagcactacaagacattcagaaagaaaagtcactgaaagaaaaagaactggtaaatgagaagtctaaattggcagagatagaagaaattaaatgtagacaagaaaaagaaatcactaaactaaacgaagaactcaagtcccacaaactagaaagcataaaggagataacaaatcttaaagatgctaaacagcttctaattcagcagaaattagaacttcaaggaaaagcggactccctgaaggcagctgttgaacaggagaagagaaatcagcagatactaaaagaccaggtgaaaaaggaagaagaggagctgaagaaagaatttattgagaaagaagctaagttgcattccgaaataaaagaaaaggaagtaggaatgaagaagcatgaagaaaatgaggctaaacttaccatgcagattacagcattaaatgaaaacttaggcactgtgaagaaggagtggcaatctagtcaacggagagttagtgagcttgagaaacaaacggatgacttacggggtgaaattgcagtattagaagcaacggttcagaataatcaagatgaaaggagagcactactggaaagatgtcttaaaggagaaggtgaaatagaaaagcttcaaaccaaagtattagaattgcaaagaaagctggataatacaactgcagcagtgcaggagctgggcagagaaaaccaatcacttcagatcaaacatacacaagcgttgaatagaaagtgggccgaagacaatgaagtacaaaactgtatggcctgtgggaaaggcttttcagtaacagtgagacggcatcactgccgacagtgtggaaatatcttctgtgctgaatgttcagccaaaaatgccttaactccttcctccaagaagcctgttcgtgtctgtgatgcatgtttcaatgacttgcaaggataatgggttatcacaacttcagagtaatattacactaacattagatttttaataaatgtacttaatagaggtcttggactactatttggtttggacactggttgcaatactagaccaaataggaattagtatattttggaatgttatggatatcaagtaaaactcttctatttttgtgagacttgggcttatcatctttcattacttttttcccatttagcccctggaatagctttcatgccaagtttagaattagccaatgaaatgtaaataaactttggacagaaaatagcaatgtatttttttaatataatttcattattcacaaatgaagaatgcaattccatagcttacttctttctcctaaatttaatgtacaaaaatgtacatggatgatattatcacttgttgctgtttttgttgcacaatagcacattaattatattaaatattctctttgtgaagttatgcacagaactgtaacactttcctctgcctttttctcttatatgtgggttcatggttcagttgcattgttatgttatgaatttactacttgggtgttctaaatacagtttatcttaaaatatgtagtaatatgaattcaaaaatggtttttgttttaacaatattaattaaattttcttgggtggattttataaaaacctctgtaaaatcaatttgtttacttatagttatctggggttgtattgcaaagaatagggttaatttttctttttgtctttttctgtctctttcttaaactcccacgcattgtccatttagaatcttagaaagcttcttaccctcgctgtcagttggaggatgaataataaacattgtataatgttcttattctcggtttcttgtaagtgggaagtcttttgagatcagccttcatatcatacccttattttgtctctctagcatcttcaggaacctgagtttgctttttacatagatctgattttttcctttatttggtttaacattttcaagcatagatcagcttcatgtatttgttttataattttgcatcttaaagctagtaactaatattgctgtggtcttattggtgaaaacaaaatataaaatgataagaagacattaaatattttactttctatttcttaccctattgggaagaatttttaaaagttgtaaaattgacttaaagttaaaatggttctgaatttggtgttccatgtcaactgttcccagttttaattttaactttgcaaaaataatgttgtgaaattccctttaagtaactaacacctagaaatagagtatcaccaaaaacaaatgtatttaggaatcccagttacaataaaaactgaaacagcatggctaagcatcttaaggataattaagaaattagcttatttgtatgctgaacaatggaatcgaactttaatttagcatagtcttattaatttggaaaattgtaaaacatctcaagagagaagttattaatattggtttattaatctttctagagaagaagtgtagttatacattcattcagtgcaatcattttataacagtagttaatatttcatttataatagttcttaatatacatttgctttcaaatattctgaaatgaaattatattcatgctatacctacagtgtatgtaaactaaagagatcactacatatttgtttaattatttaaaaaaaaatttaagtaaaccctgttgtcattagctattaagaacattgattaagtccctggacttggataaacatatatccttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatgttcacagcaccactgttttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgatttttaatagaaagaagacaaagctgctggtataggatttgttcctttgaagaaaaaatgagggaaacaaacacaaaaacctcaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagtttttttaaaaaaatgcactttggctataaaaccatggatgatttgatccataagatttaaatgtgccaccattatagtattcctagacatgagcttgatgaatggtattctgtaattataacgtgccacacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaatgcagttgtgtatatgacattctgtaattccttgaactggatcatatattcataagttctgtagatacttatgcatgaacattttctcatttagttcttgggttcattatttgtattgtgtttactacttgtgatcatgtagttgtgccttactttgtgagaaaggttagctcagtaaatactgcaatttctaaactcagtgattggaaggttattaattataaatgtaactgataaagtacgtgacagcatttaaatctgtataaagaacaatggaaggatccttattgaattgttgcttttttttaatatgtttaaatattatattaaaaacatttctttctaaa

SEQ ID NO: 435867 - DNA, 7967 bp, Homo sapiens
ggccgcgggcgggcccgcccatctgtcagttacgggggctgcccggcgggcgggctggaggcgctcgcaggctgcctagtcgttcgctcgctctctctcgcgtgctccctctcgccgcctgtggggaagtcggggccgcccgagcggccgtcgccaccgcctcgccccgacctccttcccggtcccctcccggcccagtccctcccgcccgcgcaccccgagtagtgagtggccccgcgcaggtctggagagtcaccgcggcggcgccgggtggtggttaaaccatgttaaggaggattttacagaggactcctgggagagttggctctcaaggttctgatttagattcatcagcaactcctataaacacagtggacgtcaataatgaaagctcttcagagggtttcatatgtccccagtgtatgaaatctcttggatctgctgatgaacttttcaaacattatgaagctgttcatgatgctggtaatgactcaggtcatggaggagagtctaatcttgctttgaagcgagatgatgtaacactgctcagacaagaggtccaagacctacaggcttcacttaaggaagaaaaatggtactcggaagaattaaagaaggaattagaaaaatatcaagggctgcagcagcaagaggccaaacctgatgggttggtgactgattcatcagcagaactacagtctttggaacagcaattagaagaagcccaaacagaaaattttaatattaagcaaatgaaagacttatttgaacagaaagcagcccaacttgctactgaaattgcagatataaagtcaaagtatgatgaagaaaggagtcttcgagaagctgctgaacaaaaagtgacacgtctgacagaagaattaaacaaagaggcaactgtaattcaagatctgaagacggaactgcttcagagacctggtatagaagatgttgccgtgctaaagaaagaactggtccaagttcaaacactaatggataacatgaccttggaacgtgagcgagaatctgaaaaactcaaagatgaatgcaaaaaattgcagtcacaatatgctagctcagaggccacaataagccagctaaggagtgaacttgccaaaggcccccaggaagttgctgtatatgtacaggaactacaaaaactgaaaagttcagttaatgaattaacacaaaaaaatcagaccttgacagaaaacttgctgaaaaaagaacaagactatactaagttagaggagaaacataatgaagaatctgtgagtaaaaagaatattcaggcaacccttcatcaaaaagacctagattgtcaacagcttcagtcaagattgtctgcatctgaaacctcactgcatagaatacatgtagaactaagtgaaaaaggagaagctactcaaaagctcaaagaagaattatctgaggtagagaccaagtaccagcatctaaaggcggagtttaagcagctacaacaacagagagaagaaaaggagcagcatgggttacaactccaaagtgaaattaatcaattacatagcaaacttctggagacagagcgccaactaggggaagctcatggtaggctgaaggaacagagacagctttcaagtgaaaagttgatggataaagaacaacaagtggctgatttacaactcaaactttctcggttagaagagcagttgaaggaaaaagttacaaattctacagaattgcagcatcaattagataaaacaaagcaacagcatcaagaacaacaggctcttcagcaaagcaccacggcaaaacttcgagaagctcagaatgatttggaacaagttctacgtcaaattggcgataaggaccaaaagatccagaaccttgaagctttattacagaagagtaaagaaaatatttcattactagaaaaagaaagagaagatctttatgcaaaaattcaggctggtgaaggagagactgctgttcttaaccagttacaagaaaaaaaccatacactacaggagcaagtaactcaactaacagagaagctgaagaatcagtcagaaagtcataaacaagcccaggagaatttgcatgaccaggtacaagagcagaaggcacatcttagagctgcacaagaccgtgtcctttccctagaaactagtgtcaatgaattaaatagtcaattaaatgaaagcaaggagaaggtctcccagcttgacatacagattaaagccaaaaccgaactattactatcagcagaagcagcaaaaactgctcaaagagctgatcttcagaatcatttggacacagctcaaaatgcattacaagataaacagcaggagttaaataagattactactcagttggatcaggtcactgcaaagttacaagacaagcaagaacattgcagtcagctggaaagtcatcttaaagaatataaagagaaatacctctctttagaacagaaaaccgaagagctagaaggtcaaattaagaaactagaagctgatagtcttgaagttaaagcaagcaaggagcaggctttgcaagatctacaacagcaaagacagctgaacacagatttagagctcagagccacagaattgagtaaacaacttgaaatggagaaggaaatagtatccagtacaagattggatctacagaaaaaatctgaagcccttgaaagtatcaagcaaaagcttaccaagcaagaggaagaaaaacaaatcctgaaacaagattttgaaactttaagtcaagaaacaaagattcagcatgaggaattgaataacagaattcaaacaacagtaacagaactacaaaaagtgaaaatggagaaagaagctttaatgacagagctttctacagtaaaggacaaactatcaaaagtttctgattctttgaaaaactctaaaagtgaatttgaaaaggagaatcagaaaggaaaagccgctatattagacttggaaaaaacttgcaaagaattaaagcatcaacttcaagtgcagatggaaaacacacttaaggaacagaaggaactgaaaaagtcacttgaaaaagagaaggaggcttctcatcagttgaaattggaactcaattcaatgcaggaacaacttatacaggcccagaatactttaaaacaaaatgaaaaagaagagcaacaacttcaggggaacataaatgagctaaagcaatcaagtgaacagaagaaaaaacaaattgaagcactccaaggagagcttaaaattgctgttttacagaagacagagcttgagaataaactacagcagcagttaacacaggcagcccaggaacttgcagcagagaaagagaaaatatcagtattacaaaacaactatgaaaaaagtcaggaaactttcaaacagcttcaatctgatttctatgggagggaatctgaacttctagccaccaggcaagatcttaagtctgtagaagagaagctttctctagcacaggaggacttgatttcaaacagaaatcaaattggaaatcaaaataaattgattcaagaactgaagactgccaaggctacattggagcaggattcagcaaagaaagaacagcaattgcaggagcgatgtaaagcactacaagacattcagaaagaaaagtcactgaaagaaaaagaactggtaaatgagaagtctaaattggcagagatagaagaaattaaatgtagacaagaaaaagaaatcactaaactaaacgaagaactcaagtcccacaaactagaaagcataaaggagataacaaatcttaaagatgctaaacagcttctaattcagcagaaattagaacttcaaggaaaagcggactccctgaaggcagctgttgaacaggagaagagaaatcagcagatactaaaagaccaggtgaaaaaggaagaagaggagctgaagaaagaatttattgagaaagaagctaagttgcattccgaaataaaagaaaaggaagtaggaatgaagaagcatgaagaaaatgaggctaaacttaccatgcagattacagcattaaatgaaaacttaggcactgtgaagaaggagtggcaatctagtcaacggagagttagtgagcttgagaaacaaacggatgacttacggggtgaaattgcagtattagaagcaacggttcagaataatcaagatgaaaggagagcactactggaaagatgtcttaaaggagaaggtgaaatagaaaagcttcaaaccaaagtattagaattgcaaagaaagctggataatacaactgcagcagtgcaggagctgggcagagaaaaccaatcacttcagatcaaacatacacaagcgttgaatagaaagtgggccgaagacaatgaagtacaaaactgtatggcctgtgggaaaggcttttcagtaacagtgagacggcatcactgccgacagtgtggaaatatcttctgtgctgaatgttcagccaaaaatgccttaactccttcctccaagaagcctgttcgtgtctgtgatgcatgtttcaatgacttgcaaggataatgggttatcacaacttcagagtaatattacactaacattagatttttaataaatgtacttaatagaggtcttggactactatttggtttggacactggttgcaatactagaccaaataggaattagtatattttggaatgttatggatatcaagtaaaactcttctatttttgtgagacttgggcttatcatctttcattacttttttcccatttagcccctggaatagctttcatgccaagtttagaattagccaatgaaatgtaaataaactttggacagaaaatagcaatgtatttttttaatataatttcattattcacaaatgaagaatgcaattccatagcttacttctttctcctaaatttaatgtacaaaaatgtacatggatgatattatcacttgttgctgtttttgttgcacaatagcacattaattatattaaatattctctttgtgaagttatgcacagaactgtaacactttcctctgcctttttctcttatatgtgggttcatggttcagttgcattgttatgttatgaatttactacttgggtgttctaaatacagtttatcttaaaatatgtagtaatatgaattcaaaaatggtttttgttttaacaatattaattaaattttcttgggtggattttataaaaacctctgtaaaatcaatttgtttacttatagttatctggggttgtattgcaaagaatagggttaatttttctttttgtctttttctgtctctttcttaaactcccacgcattgtccatttagaatcttagaaagcttcttaccctcgctgtcagttggaggatgaataataaacattgtataatgttcttattctcggtttcttgtaagtgggaagtcttttgagatcagccttcatatcatacccttattttgtctctctagcatcttcaggaacctgagtttgctttttacatagatctgattttttcctttatttggtttaacattttcaagcatagatcagcttcatgtatttgttttataattttgcatcttaaagctagtaactaatattgctgtggtcttattggtgaaaacaaaatataaaatgataagaagacattaaatattttactttctatttcttaccctattgggaagaatttttaaaagttgtaaaattgacttaaagttaaaatggttctgaatttggtgttccatgtcaactgttcccagttttaattttaactttgcaaaaataatgttgtgaaattccctttaagtaactaacacctagaaatagagtatcaccaaaaacaaatgtatttaggaatcccagttacaataaaaactgaaacagcatggctaagcatcttaaggataattaagaaattagcttatttgtatgctgaacaatggaatcgaactttaatttagcatagtcttattaatttggaaaattgtaaaacatctcaagagagaagttattaatattggtttattaatctttctagagaagaagtgtagttatacattcattcagtgcaatcattttataacagtagttaatatttcatttataatagttcttaatatacatttgctttcaaatattctgaaatgaaattatattcatgctatacctacagtgtatgtaaactaaagagatcactacatatttgtttaattatttaaaaaaaaatttaagtaaaccctgttgtcattagctattaagaacattgattaagtccctggacttggataaacatatatccttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatgttcacagcaccactgttttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgagttaaaattaagtcttgctgggttagtgtacaataaactatacctacagacttttttttaatagaaagaagacaaagctgctggtataggatttgttcctttgaagaaaaaatgagggaaacaaacacaaaaacctcaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagtttttttaaaaaaatgcactttggctataaaaccatggatgatttgatccataagatttaaatgtgccaccattatagtattcctagacatgagcttgatgaatggtattctgtaattataacgtgccacacattattgtgtcttaattgcccttagcctgaattttaatgatcaatttgttattgttgcagatgtgaatattgtgcataaacttactaaatttatgtaaaatttattgtaacacaatgcagttgtgtatatgacattctgtaattccttgaactggatcatatattcataagttctgtagatacttatgcatgaacattttctcatttagttcttgggttcattatttgtattgtgtttactacttgtgatcatgtagttgtgccttactttgtgagaaaggttagctcagtaaatactgcaatttctaaactcagtgattggaaggttattaattataaatgtaactgataaagtacgtgacagcatttaaatctgtataaagaacaatggaaggatccttattgaattgttgcttttttttaatatgtttaaatattatattaaaaacatttctttctaaa

SEQ ID NO: 435868 - DNA, 8062 bp, Homo sapiens
ggccgcgggcgggcccgcccatctgtcagttacgggggctgcccggcgggcgggctggaggcgctcgcaggctgcctagtcgttcgctcgctctctctcgcgtgctccctctcgccgcctgtggggaagtcggggccgcccgagcggccgtcgccaccgcctcgccccgacctccttcccggtcccctcccggcccagtccctcccgcccgcgcaccccgagtagtgagtggccccgcgcaggtctggagagtcaccgcggcggcgccgggtggtggttaaaccatgttaaggaggattttacagaggactcctgggagagttggctctcaaggttctgatttagattcatcagcaactcctataaacacagtggacgtcaataatgaaagctcttcagagggtttcatatgtccccagtgtatgaaatctcttggatctgctgatgaacttttcaaacattatgaagctgttcatgatgctggtaatgactcaggtcatggaggagagtctaatcttgctttgaagcgagatgatgtaacactgctcagacaagaggtccaagacctacaggcttcacttaaggaagaaaaatggtactcggaagaattaaagaaggaattagaaaaatatcaagggctgcagcagcaagaggccaaacctgatgggttggtgactgattcatcagcagaactacagtctttggaacagcaattagaagaagcccaaacagaaaattttaatattaagcaaatgaaagacttatttgaacagaaagcagcccaacttgctactgaaattgcagatataaagtcaaagtatgatgaagaaaggagtcttcgagaagctgctgaacaaaaagtgacacgtctgacagaagaattaaacaaagaggcaactgtaattcaagatctgaagacggaactgcttcagagacctggtatagaagatgttgccgtgctaaagaaagaactggtccaagttcaaacactaatggataacatgaccttggaacgtgagcgagaatctgaaaaactcaaagatgaatgcaaaaaattgcagtcacaatatgctagctcagaggccacaataagccagctaaggagtgaacttgccaaaggcccccaggaagttgctgtatatgtacaggaactacaaaaactgaaaagttcagttaatgaattaacacaaaaaaatcagaccttgacagaaaacttgctgaaaaaagaacaagactatactaagttagaggagaaacataatgaagaatctgtgagtaaaaagaatattcaggcaacccttcatcaaaaagacctagattgtcaacagcttcagtcaagattgtctgcatctgaaacctcactgcatagaatacatgtagaactaagtgaaaaaggagaagctactcaaaagctcaaagaagaattatctgaggtagagaccaagtaccagcatctaaaggcggagtttaagcagctacaacaacagagagaagaaaaggagcagcatgggttacaactccaaagtgaaattaatcaattacatagcaaacttctggagacagagcgccaactaggggaagctcatggtaggctgaaggaacagagacagctttcaagtgaaaagttgatggataaagaacaacaagtggctgatttacaactcaaactttctcggttagaagagcagttgaaggaaaaagttacaaattctacagaattgcagcatcaattagataaaacaaagcaacagcatcaagaacaacaggctcttcagcaaagcaccacggcaaaacttcgagaagctcagaatgatttggaacaagttctacgtcaaattggcgataaggaccaaaagatccagaaccttgaagctttattacagaagagtaaagaaaatatttcattactagaaaaagaaagagaagatctttatgcaaaaattcaggctggtgaaggagagactgctgttcttaaccagttacaagaaaaaaaccatacactacaggagcaagtaactcaactaacagagaagctgaagaatcagtcagaaagtcataaacaagcccaggagaatttgcatgaccaggtacaagagcagaaggcacatcttagagctgcacaagaccgtgtcctttccctagaaactagtgtcaatgaattaaatagtcaattaaatgaaagcaaggagaaggtctcccagcttgacatacagattaaagccaaaaccgaactattactatcagcagaagcagcaaaaactgctcaaagagctgatcttcagaatcatttggacacagctcaaaatgcattacaagataaacagcaggagttaaataagattactactcagttggatcaggtcactgcaaagttacaagacaagcaagaacattgcagtcagctggaaagtcatcttaaagaatataaagagaaatacctctctttagaacagaaaaccgaagagctagaaggtcaaattaagaaactagaagctgatagtcttgaagttaaagcaagcaaggagcaggctttgcaagatctacaacagcaaagacagctgaacacagatttagagctcagagccacagaattgagtaaacaacttgaaatggagaaggaaatagtatccagtacaagattggatctacagaaaaaatctgaagcccttgaaagtatcaagcaaaagcttaccaagcaagaggaagaaaaacaaatcctgaaacaagattttgaaactttaagtcaagaaacaaagattcagcatgaggaattgaataacagaattcaaacaacagtaacagaactacaaaaagtgaaaatggagaaagaagctttaatgacagagctttctacagtaaaggacaaactatcaaaagtttctgattctttgaaaaactctaaaagtgaatttgaaaaggagaatcagaaaggaaaagccgctatattagacttggaaaaaacttgcaaagaattaaagcatcaacttcaagtgcagatggaaaacacacttaaggaacagaaggaactgaaaaagtcacttgaaaaagagaaggagttgttgattgaaagcagacttgtgttgtagatgccagccatgcttctcatcagttgaaattggaactcaattcaatgcaggaacaacttatacaggcccagaatactttaaaacaaaatgaaaaagaagagcaacaacttcaggggaacataaatgagctaaagcaatcaagtgaacagaagaaaaaacaaattgaagcactccaaggagagcttaaaattgctgttttacagaagacagagcttgagaataaactacagcagcagttaacacaggcagcccaggaacttgcagcagagaaagagaaaatatcagtattacaaaacaactatgaaaaaagtcaggaaactttcaaacagcttcaatctgatttctatgggagggaatctgaacttctagccaccaggcaagatcttaagtctgtagaagagaagctttctctagcacaggaggacttgatttcaaacagaaatcaaattggaaatcaaaataaattgattcaagaactgaagactgccaaggctacattggagcaggattcagcaaagaaagaacagcaattgcaggagcgatgtaaagcactacaagacattcagaaagaaaagtcactgaaagaaaaagaactggtaaatgagaagtctaaattggcagagatagaagaaattaaatgtagacaagaaaaagaaatcactaaactaaacgaagaactcaagtcccacaaactagaaagcataaaggagataacaaatcttaaagatgctaaacagcttctaattcagcagaaattagaacttcaaggaaaagcggactccctgaaggcagctgttgaacaggagaagagaaatcagcagatactaaaagaccaggtgaaaaaggaagaagaggagctgaagaaagaatttattgagaaagaagctaagttgcattccgaaataaaagaaaaggaagtaggaatgaagaagcatgaagaaaatgaggctaaacttaccatgcagattacagcattaaatgaaaacttaggcactgtgaagaaggagtggcaatctagtcaacggagagttagtgagcttgagaaacaaacggatgacttacggggtgaaattgcagtattagaagcaacggttcagaataatcaagatgaaaggagagcactactggaaagatgtcttaaaggagaaggtgaaatagaaaagcttcaaaccaaagtattagaattgcaaagaaagctggataatacaactgcagcagtgcaggagctgggcagagaaaaccaatcacttcagatcaaacatacacaagcgttgaatagaaagtgggccgaagacaatgaagtacaaaactgtatggcctgtgggaaaggcttttcagtaacagtgagacggcatcactgccgacagtgtggaaatatcttctgtgctgaatgttcagccaaaaatgccttaactccttcctccaagaagcctgttcgtgtctgtgatgcatgtttcaatgacttgcaaggataatgggttatcacaacttcagagtaatattacactaacattagatttttaataaatgtacttaatagaggtcttggactactatttggtttggacactggttgcaatactagaccaaataggaattagtatattttggaatgttatggatatcaagtaaaactcttctatttttgtgagacttgggcttatcatctttcattacttttttcccatttagcccctggaatagctttcatgccaagtttagaattagccaatgaaatgtaaataaactttggacagaaaatagcaatgtatttttttaatataatttcattattcacaaatgaagaatgcaattccatagcttacttctttctcctaaatttaatgtacaaaaatgtacatggatgatattatcacttgttgctgtttttgttgcacaatagcacattaattatattaaatattctctttgtgaagttatgcacagaactgtaacactttcctctgcctttttctcttatatgtgggttcatggttcagttgcattgttatgttatgaatttactacttgggtgttctaaatacagtttatcttaaaatatgtagtaatatgaattcaaaaatggtttttgttttaacaatattaattaaattttcttgggtggattttataaaaacctctgtaaaatcaatttgtttacttatagttatctggggttgtattgcaaagaatagggttaatttttctttttgtctttttctgtctctttcttaaactcccacgcattgtccatttagaatcttagaaagcttcttaccctcgctgtcagttggaggatgaataataaacattgtataatgttcttattctcggtttcttgtaagtgggaagtcttttgagatcagccttcatatcatacccttattttgtctctctagcatcttcaggaacctgagtttgctttttacatagatctgattttttcctttatttggtttaacattttcaagcatagatcagcttcatgtatttgttttataattttgcatcttaaagctagtaactaatattgctgtggtcttattggtgaaaacaaaatataaaatgataagaagacattaaatattttactttctatttcttaccctattgggaagaatttttaaaagttgtaaaattgacttaaagttaaaatggttctgaatttggtgttccatgtcaactgttcccagttttaattttaactttgcaaaaataatgttgtgaaattccctttaagtaactaacacctagaaatagagtatcaccaaaaacaaatgtatttaggaatcccagttacaataaaaactgaaacagcatggctaagcatcttaaggataattaagaaattagcttatttgtatgctgaacaatggaatcgaactttaatttagcatagtcttattaatttggaaaattgtaaaacatctcaagagagaagttattaatattggtttattaatctttctagagaagaagtgtagttatacattcattcagtgcaatcattttataacagtagttaatatttcatttataatagttcttaatatacatttgctttcaaatattctgaaatgaaattatattcatgctatacctacagtgtatgtaaactaaagagatcactacatatttgtttaattatttaaaaaaaaatttaagtaaaccctgttgtcattagctattaagaacattgattaagtccctggacttggataaacatatatccttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatgttcacagcaccactgttttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgagttaaaattaagtcttgctgggttagtgtacaataaactatacctacagacttttttttaatagaaagaagacaaagctgctggtataggatttgttcctttgaagaaaaaatgagggaaacaaacacaaaaacctcaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagtttttttaaaaaaatgcactttggctataaaaccatggatgatttgatccataagatttaaatgtgccaccattatagtattcctagacatgagcttgatgaatggtattctgtaattataacgtgccacacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaatgcagttgtgtatatgacattctgtaattccttgaactggatcatatattcataagttctgtagatacttatgcatgaacattttctcatttagttcttgggttcattatttgtattgtgtttactacttgtgatcatgtagttgtgccttactttgtgagaaaggttagctcagtaaatactgcaatttctaaactcagtgattggaaggttattaattataaatgtaactgataaagtacgtgacagcatttaaatctgtataaagaacaatggaaggatccttattgaattgttgcttttttttaatatgtttaaatattatattaaaaacatttctttctaaa

SEQ ID NO: 435869 - DNA, 3873 bp, Homo sapiens
ctggttatagtgaggagttccataataaattctatgtaaaatgtttagcatagtgtttgataaataggaagcattcaatttaattataacagagattaagttaacatattgaaacatatcattaaataatataccaatgacttgaaagctaatgtaccttcataatgtagttggtggtattcatgtagtttcataatacttttggtatagtttttattcttgaaattgtttaatttttgtcatttacagcatcactgccgacagtgtggaaatatcttctgtgctgaatgttcagccaaaaatgccttaactccttcctccaagaagcctgttcgtgtctgtgatgcatgtttcaatgacttgcaaggataatgggttatcacaacttcagagtaatattacactaacattagatttttaataaatgtacttaatagaggtcttggactactatttggtttggacactggttgcaatactagaccaaataggaattagtatattttggaatgttatggatatcaagtaaaactcttctatttttgtgagacttgggcttatcatctttcattacttttttcccatttagcccctggaatagctttcatgccaagtttagaattagccaatgaaatgtaaataaactttggacagaaaatagcaatgtatttttttaatataatttcattattcacaaatgaagaatgcaattccatagcttacttctttctcctaaatttaatgtacaaaaatgtacatggatgatattatcacttgttgctgtttttgttgcacaatagcacattaattatattaaatattctctttgtgaagttatgcacagaactgtaacactttcctctgcctttttctcttatatgtgggttcatggttcagttgcattgttatgttatgaatttactacttgggtgttctaaatacagtttatcttaaaatatgtagtaatatgaattcaaaaatggtttttgttttaacaatattaattaaattttcttgggtggattttataaaaacctctgtaaaatcaatttgtttacttatagttatctggggttgtattgcaaagaatagggttaatttttctttttgtctttttctgtctctttcttaaactcccacgcattgtccatttagaatcttagaaagcttcttaccctcgctgtcagttggaggatgaataataaacattgtataatgttcttattctcggtttcttgtaagtgggaagtcttttgagatcagccttcatatcatacccttattttgtctctctagcatcttcaggaacctgagtttgctttttacatagatctgattttttcctttatttggtttaacattttcaagcatagatcagcttcatgtatttgttttataattttgcatcttaaagctagtaactaatattgctgtggtcttattggtgaaaacaaaatataaaatgataagaagacattaaatattttactttctatttcttaccctattgggaagaatttttaaaagttgtaaaattgacttaaagttaaaatggttctgaatttggtgttccatgtcaactgttcccagttttaattttaactttgcaaaaataatgttgtgaaattccctttaagtaactaacacctagaaatagagtatcaccaaaaacaaatgtatttaggaatcccagttacaataaaaactgaaacagcatggctaagcatcttaaggataattaagaaattagcttatttgtatgctgaacaatggaatcgaactttaatttagcatagtcttattaatttggaaaattgtaaaacatctcaagagagaagttattaatattggtttattaatctttctagagaagaagtgtagttatacattcattcagtgcaatcattttataacagtagttaatatttcatttataatagttcttaatatacatttgctttcaaatattctgaaatgaaattatattcatgctatacctacagtgtatgtaaactaaagagatcactacatatttgtttaattatttaaaaaaaaatttaagtaaaccctgttgtcattagctattaagaacattgattaagtccctggacttggataaacatatatccttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatgttcacagcaccactgttttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgagttaaaattaagtcttgctgggttagtgtacaataaactatacctacagacttttttttaatagaaagaagacaaagctgctggtataggatttgttcctttgaagaaaaaatgagggaaacaaacacaaaaacctcaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagtttttttaaaaaaatgcactttggctataaaaccatggatgatttgatccataagatttaaatgtgccaccattatagtattcctagacatgagcttgatgaatggtattctgtaattataacgtgccacacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaatgcagttgtgtatatgacattctgtaattccttgaactggatcatatattcataagttctgtagatacttatgcatgaacattttctcatttagttcttgggttcattatttgtattgtgtttactacttgtgatcatgtagttgtgccttactttgtgagaaaggttagctcagtaaatactgcaatttctaaactcagtgattggaaggttattaattataaatgtaactgataaagtacgtgacagcatttaaatctgtataaagaacaatggaaggatccttattgaattgttgcttttttttaatatgtttaaatattatattaaaaacatttctttctaaa

SEQ ID NO: 435870 - DNA, 1782 bp, Homo sapiens
attggagtttgttcaaaaagctcgggttcctgccgccgcgtttcacctggggagaaagccccgaccccaatgcttctacccggttcttctgagcccaggattgatctcacgagttcagtcccctacggtcggctctccgtagtcccacacgaatggcttttatcagaccctcttttaggcgactatactggccccgaaatcttcttttttgttcttactcttctctatcatgtattgttcttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgtttgctggtactattattttgtcagtcagttaaagctggcatgtacagctcttggctttaatgaaaagcacattgacataatgttagtaaattccaaaccccggcacagaatgtgagttaaaattaagtcttgctgggttagtgtacaataaactatacctacagacttttttttaatagaaagaagacaaagctgctggtataggatttgttcctttgaagaaaaaatgagggaaacaaacacaaaaacctcaatgcagtgtataaataacattttgttcaactacctcttaatgtggaattatctactttaatagtttcctgacagtaatgttaaatagtaactgccaaatttgttattttcccatctctcttaaaaaagtctttatgattattttatatagttttgagaactttaaagccacttttttttaaccttacatttgcataaaaatgtttagcttttaagtagagagcaaattatgatcatatattttgatattcatgacctgtttgactataggagtttttttaaaaaaatgcactttggctataaaaccatggatgatttgatccataagatttaaatgtgccaccattatagtattcctagacatgagcttgatgaatggtattctgtaattataacgtgccacacattattgtgtcttaattgcccttagcctgaattttaatgatcaatttgttattgttgcagatgtgaatattgtgcataaacttactaaatttatgtaaaattgtataaaatagaattagaagtcactaagttctttctgtgtagaagtaataaatttattgtaacacaatgcagttgtgtatatgacattctgtaattccttgaactggatcatatattcataagttctgtagatacttatgcatgaacattttctcatttagttcttgggttcattatttgtattgtgtttactacttgtgatcatgtagttgtgccttactttgtgagaaaggttagctcagtaaatactgcaatttctaaactcagtgattggaaggttattaattataaatgtaactgataaagtacgtgacagcatttaaatctgtataaagaacaatggaaggatccttattgaattgttgcttttttttaatatgtttaaatattatattaaaaacatttctttctaaa

SEQ ID NO: 435871 - DNA, 3907 bp, Homo sapiens
  misc_feature (3793)..(3794): n is a, c, g, or t
  misc_feature (3805)..(3805): n is a, c, g, or t
  misc_feature (3807)..(3807): n is a, c, g, or t
  misc_feature (3822)..(3822): n is a, c, g, or t
  misc_feature (3829)..(3829): n is a, c, g, or t
  misc_feature (3836)..(3836): n is a, c, g, or t
  misc_feature (3838)..(3838): n is a, c, g, or t
  misc_feature (3840)..(3840): n is a, c, g, or t
  misc_feature (3854)..(3854): n is a, c, g, or t
  misc_feature (3856)..(3856): n is a, c, g, or t
  misc_feature (3863)..(3863): n is a, c, g, or t
  misc_feature (3865)..(3865): n is a, c, g, or t
  misc_feature (3872)..(3873): n is a, c, g, or t
  misc_feature (3876)..(3876): n is a, c, g, or t
  misc_feature (3883)..(3883): n is a, c, g, or t
ggccgcgggcgggcccgcccatctgtcagttacgggggctgcccggcgggcgggctggaggcgctcgcaggctgcctagtcgttcgctcgctctctctcgcgtgctccctctcgccgcctgtggggaagtcggggccgcccgagcggccgtcgccaccgcctcgccccgacctccttcccggtcccctcccggcccagtccctcccgcccgcgcaccccgagtagtgagtggccccgcgcaggtctggagagtcaccgcggcggcgccgggtggtggttaaaccatgttaaggaggattttacagaggactcctgggagagttggctctcaaggttctgatttagattcatcagcaactcctataaacacagtggacgtcaataatgaaagctcttcagagggtttcatatgtccccagtgtatgaaatctcttggatctgctgatgaacttttcaaacattatgaagctgttcatgatgctggtaatgactcaggtcatggaggagagtctaatcttgctttgaagcgagatgatgtaacactgctcagacaagaggtccaagacctacaggcttcacttaaggaagaaaaatggtactcggaagaattaaagaaggaattagaaaaatatcaagggctgcagcagcaagaggccaaacctgatgggttggtgactgattcatcagcagaactacagtctttggaacagcaattagaagaagcccaaacagaaaattttaatattaagcaaatgaaagacttatttgaacagaaagcagcccaacttgctactgaaattgcagatataaagtcaaagtatgatgaagaaaggagtcttcgagaagctgctgaacaaaaagtgacacgtctgacagaagaattaaacaaagaggcaactgtaattcaagatctgaagacggaactgcttcagagacctggtatagaagatgttgccgtgctaaagaaagaactggtccaagttcaaacactaatggataacatgaccttggaacgtgagcgagaatctgaaaaactcaaagatgaatgcaaaaaattgcagtcacaatatgctagctcagaggccacaataagccagctaaggagtgaacttgccaaaggcccccaggaagttgctgtatatgtacaggaactacaaaaactgaaaagttcagttaatgaattaacacaaaaaaatcagaccttgacagaaaacttgctgaaaaaagaacaagactatactaagttagaggagaaacataatgaagaatctgtgagtaaaaagaatattcaggcaacccttcatcaaaaagacctagattgtcaacagcttcagtcaagattgtctgcatctgaaacctcactgcatagaatacatgtagaactaagtgaaaaaggagaagctactcaaaagctcaaagaagaattatctgaggtagagaccaagtaccagcatctaaaggcggagtttaagcagctacaacaacagagagaagaaaaggagcagcatgggttacaactccaaagtgaaattaatcaattacatagcaaacttctggagacagagcgccaactaggggaagctcatggtaggctgaaggaacagagacagctttcaagtgaaaagttgatggataaagaacaacaagtggctgatttacaactcaaactttctcggttagaagagcagttgaaggaaaaagttacaaattctacagaattgcagcatcaattagataaaacaaagcaacagcatcaagaacaacaggctcttcagcaaagcaccacggcaaaacttcgagaagctcagaatgatttggaacaagttctacgtcaaattggcgataaggaccaaaagatccagaaccttgaagctttattacagaagagtaaagaaaatatttcattactagaaaaagaaagagaagatctttatgcaaaaattcaggctggtgaaggagagactgctgttcttaaccagttacaagaaaaaaaccatacactacaggagcaagtaactcaactaacagagaagctgaagaatcagtcagaaagtcataaacaagcccaggagaatttgcatgaccaggtacaagagcagaaggcacatcttagagctgcacaagaccgtgtcctttccctagaaactagtgtcaatgaattaaatagtcaattaaatgaaagcaaggagaaggtctcccagcttgacatacagattaaagccaaaaccgaactattactatcagcagaagcagcaaaaactgctcaaagagctgatcttcagaatcatttggacacagctcaaaatgcattacaagataaacagcaggagttaaataagattactactcagttggatcaggtcactgcaaagttacaagacaagcaagaacattgcagtcagctggaaagtcatcttaaagaatataaagagaaatacctctctttagaacagaaaaccgaagagctagaaggtcaaattaagaaactagaagctgatagtcttgaagttaaagcaagcaaggagcaggctttgcaagatctacaacagcaaagacagctgaacacagatttagagctcagagccacagaattgagtaaacaacttgaaatggagaaggaaatagtatccagtacaagattggatctacagaaaaaatctgaagcccttgaaagtatcaagcaaaagcttaccaagcaagaggaagaaaaacaaatcctgaaacaagattttgaaactttaagtcaagaaacaaagattcagcatgaggaattgaataacagaattcaaacaacagtaacagaactacaaaaagtgaaaatggagaaagaagctttaatgacagagctttctacagtaaaggacaaactatcaaaagtttctgattctttgaaaaactctaaaagtgaatttgaaaaggagaatcagaaaggaaaagccgctatattagacttggaaaaaacttgcaaagaattaaagcatcaacttcaagtgcagatggaaaacacacttaaggaacagaaggaactgaaaaagtcacttgaaaaagagaaggaggcttctcatcagttgaaattggaactcaattcaatgcaggaacaacttatacaggcccagaatactttaaaacaaaatgaaaaagaagagcaacaacttcaggggaacataaatgagctaaagcaatcaagtgaacagaagaaaaaacaaattgaagcactccaaggagagcttaaaattgctgttttacagaagacagagcttgagaataaactacagcagcagttaacacaggcagcccaggaacttgcagcagagaaagagaaaatatcagtattacaaaacaactatgaaaaaagtcaggaaactttcaaacagcttcaatctgatttctatgggagggaatctgaacttctagccaccaggcaagatcttaagtctgtagaagagaagctttctctagcacaggaggacttgatttcaaacagaaatcaaattggaaatcaaaataaattgattcaagaactgaagactgccaaggctacattggagcaggattcagcaaagaaagaacagcaattgcaggagcgatgtaaagcactacaagacattcagaaagaaaagtcactgaaagaaaaagaactggtaaatgagaagtctaaattggcagagatagaagaaattaaatgtagacaagaaaaagaaatcactaaactaaacgaagaactcaagtcccacaaactagaaagcataaagagatacaatcttaagatgtaacagctctaatcagcagaatnnactcagaaagngntccgagcgcgtgacnggagaancgcgttnancngtgaaggaaggtgnanattggananatgtcgnnagnggggacngggccccataacaccgaaggcggg

SEQ ID NO: 435872 - DNA, 3850 bp, Homo sapiens
  misc_feature (3736)..(3737): n is a, c, g, or t
  misc_feature (3748)..(3748): n is a, c, g, or t
  misc_feature (3750)..(3750): n is a, c, g, or t
  misc_feature (3765)..(3765): n is a, c, g, or t
  misc_feature (3772)..(3772): n is a, c, g, or t
  misc_feature (3779)..(3779): n is a, c, g, or t
  misc_feature (3781)..(3781): n is a, c, g, or t
  misc_feature (3783)..(3783): n is a, c, g, or t
  misc_feature (3797)..(3797): n is a, c, g, or t
  misc_feature (3799)..(3799): n is a, c, g, or t
  misc_feature (3806)..(3806): n is a, c, g, or t
  misc_feature (3808)..(3808): n is a, c, g, or t
  misc_feature (3815)..(3816): n is a, c, g, or t
  misc_feature (3819)..(3819): n is a, c, g, or t
  misc_feature (3826)..(3826): n is a, c, g, or t
ggccgcgggcgggcccgcccatctgtcagttacgggggctgcccggcgggcgggctggaggcgctcgcaggctgcctagtcgttcgctcgctctctctcgcgtgctccctctcgccgcctgtggggaagtcggggccgcccgagcggccgtcgccaccgcctcgccccgacctccttcccggtcccctcccggcccagtccctcccgcccgcgcaccccgagtagtgagtggccccgcgcaggtctggagagtcaccgcggcggcgccgggtggtggttaaaccatgttaaggaggattttacagaggactcctgggagagttggctctcaaggttctgatttagattcatcagcaactcctataaacacagtggacgtcaataatgaaagctcttcagagggtttcatatgtccccagtgtatgaaatctcttggatctgctgatgaacttttcaaacattatgaagctgttcatgatgctggtaatgactcaggtcatggaggagagtctaatcttgctttgaagcgagatgatgtaacactgctcagacaagaggtccaagacctacaggcttcacttaaggaagaaaaatggtactcggaagaattaaagaaggaattagaaaaatatcaagggctgcagcagcaagaggccaaacctgatgggttggtgactgattcatcagcagaactacagtctttggaacagcaattagaagaagcccaaacagaaaattttaatattaagcaaatgaaagacttatttgaacagaaagcagcccaacttgctactgaaattgcagatataaagtcaaagtatgatgaagaaaggagtcttcgagaagctgctgaacaaaaagtgacacgtctgacagaagaattaaacaaagaggcaactgtaattcaagatctgaagacggaactgcttcagagacctggtatagaagatgttgccgtgctaaagaaagaactggtccaagttcaaacactaatggataacatgaccttggaacgtgagcgagaatctgaaaaactcaaagatgaatgcaaaaaattgcagtcacaatatgctagctcagaggccacaataagccagctaaggagtgaacttgccaaaggcccccaggaagttgctgtatatgtacaggaactacaaaaactgaaaagttcagttaatgaattaacacaaaaaaatcagaccttgacagaaaacttgctgaaaaaagaacaagactatactaagttagaggagaaacataatgaagaatctgtgagtaaaaagaatattcaggcaacccttcatcaaaaagacctagattgtcaacagcttcagtcaagattgtctgcatctgaaacctcactgcatagaatacatgtagaactaagtgaaaaaggagaagctactcaaaagctcaaagaagaattatctgaggtagagaccaagtaccagcatctaaaggcggagtttaagcagctacaacaacagagagaagaaaaggagcagcatgggttacaactccaaagtgaaattaatcaattacatagcaaacttctggagacagagcgccaactaggggaagctcatggtaggctgaaggaacagagacagctttcaagtgaaaagttgatggataaagaacaacaagtggctgatttacaactcaaactttctcggttagaagagcagttgaaggaaaaagttacaaattctacagaattgcagcatcaattagataaaacaaagcaacagcatcaagaacaacaggctcttcagcaaagcaccacggcaaaacttcgagaagctcagaatgatttggaacaagttctacgtcaaattggcgataaggaccaaaagatccagaaccttgaagctttattacagaagagtaaagaaaatatttcattactagaaaaagaaagagaagatctttatgcaaaaattcaggctggtgaaggagagactgctgttcttaaccagttacaagaaaaaaaccatacactacaggagcaagtaactcaactaacagagaagctgaagaatcagtcagaaagtcataaacaagcccaggagaatttgcatgaccaggtacaagagcagaaggcacatcttagagctgcacaagaccgtgtcctttccctagaaactagtgtcaatgaattaaatagtcaattaaatgaaagcaaggagaaggtctcccagcttgacatacagattaaagccaaaaccgaactattactatcagcagaagcagcaaaaactgctcaaagagctgatcttcagaatcatttggacacagctcaaaatgcattacaagataaacagcaggagttaaataagattactactcagttggatcaggtcactgcaaagttacaagacaagcaagaacattgcagtcagctggaaagtcatcttaaagaatataaagagaaatacctctctttagaacagaaaaccgaagagctagaaggtcaaattaagaaactagaagctgatagtcttgaagttaaagcaagcaaggagcaggctttgcaagatctacaacagcaaagacagctgaacacagatttagagctcagagccacagaattgagtaaacaacttgaaatggagaaggaaatagtatccagtacaagattggatctacagaaaaaatctgaagcccttgaaagtatcaagcaaaagcttaccaagcaagaggaagaaaaacaaatcctgaaacaagattttgaaactttaagtcaagaaacaaagattcagcatgaggaattgaataacagaattcaaacaacagtaacagaactacaaaaagtgaaaatggagaaagaagctttaatgacagagctttctacagtaaaggacaaactatcaaaagtttctgattctttgaaaaactctaaaagtgaatttgaaaaggagaatcagaaaggaaaagccgctatattagacttggaaaaaacttgcaaagaattaaagcatcaacttcaagtgcagatggaaaacacacttaaggaacagaaggaactgaaaaagtcacttgaaaaagagaaggaggcttctcatcagttgaaattggaactcaattcaatgcaggaacaacttatacaggcccagaatactttaaaacaaaatgaaaaagaagagcaacaacttcaggggaacataaatgagctaaagcaatcaagtgaacagaagaaaaaacaaattgaagcactccaaggagagcttaaaattgctgttttacagaagacagagcttgagaataaactacagcagcagttaacacaggcagcccaggaacttgcagcagagaaagagaaaatatcagtattacaaaacaactatgaaaaaagtcaggaaactttcaaacagcttcaatctgatttctatgggagggaatctgaacttctagccaccaggcaagatcttaagtctgtagaagagaagctttctctagcacaggaggacttgatttcaaacagaaatcaaattggaaatcaaaataaattgattcaagaactgaagactgccaaggctacattggagcaggattcagcaaagaaagaacagcaattgcaggagcgatgtaaagcactacaagacattcagaaagaaaagtcactgaaagaaaaagaactggtaaatgagaagtctaaattggcagagatagaagaaattaaatgtagacaagaaagatacaatcttaagatgtaacagctctaatcagcagaatnnactcagaaagngntccgagcgcgtgacnggagaancgcgttnancngtgaaggaaggtgnanattggananatgtcgnnagnggggacngggccccataacaccgaaggcggg

SEQ ID NO: 435873 - DNA, 819 bp, Homo sapiens
ggcacttaacagtcagttatatgattatttccatgagaaaatgttttttccatttataaacagtaagctttaggaataaaatcgtttttctgagggatttatatatatgctattatagataaaatcttccgtagtttttttttgaattgaaaaaactataatattaatatacaattactagccatgatttcttaagaccagtttgttaattaaaggacattgactattaattccttcctcccatttttatttagagatgatgtaacactgctcagacaagaggtccaagacctacaggcttcacttaaggtaagaataaaaattgttatacctttttattttcagtgtttcagataatacctctttttaaatttactaattaaaaatcttttttattaggaagaaaaatggtactcggaagaattaaagaaggaattagaaaaatatcaagggctgcagcagcaagtaattgcttttaactacttaaagcatgtttattagttgtttatttttattgttgaaaactaaacttaatacctttttgcaagcaggtggcggcctgatataaataacttcctaatttgtttctctgtgttgaattctgatgaatgcaaacaaatgtatgaggagtgaagatgtaattttttaaaaggtgttccattaaaaatgagttactggatgggcccacgcctgtaatcccagcactttgggaggctgaggcgagagagttgcttgagccaggagttcgagaccagcctgggcaacacagggagacccctgtctctacaaaaaatttaaaaattagctgagtgtggtgcc

SEQ ID NO: 435874 - DNA, 1124 bp, Homo sapiens
  misc_feature (974)..(974): n is a, c, g, or t
  misc_feature (988)..(988): n is a, c, g, or t
  misc_feature (1008)..(1008): n is a, c, g, or t
  misc_feature (1025)..(1025): n is a, c, g, or t
gtgcgcggagaacacaaagtaaaacttctgctgttcccagtcctgcagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttatgtataaaagcatatgtgctactcatctttgctcactatgcagtcttttttaagagagcagagagtatcagatgtacaattatggaaataagaacattacttgagcatgacacttctttcagtatattgcttgatgcttcaaataaagttttgtcttgggaaaaaaaaaaacacnaaaacaaaattggngggggccggccccgaaaaanttcacacccacgtgggnggcgggggcccaggggaatggaccaggggccagcgggcccgagaaaacgggccggaagggggggtcccccaaaaagcccggggaccggggttgaaaacc

SEQ ID NO: 435875 - DNA, 1753 bp, Homo sapiens
gtgcgcggagaacacaaagtaaaacttctgctgttcccagtcctgcagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttatgtataaaagcatatgtgctactcatctttgctcactatgcagtcttttttaagagagcagagagtatcagatgtacaattatggaaataagaacattacttgagcatgacacttctttcagtatattgcttgatgcttcaaataaagttttgtcttgggaaaaaaaaaaaaaaaaaaaaaaaaaaaacaaaaaacaaagaaaaagaaaaaaaagaaaaaacaaaacaaaaaaagaaaaaagaaaagagaagagaagagacaaaagagaaaggaaagaaagaagaggagaagagaagaagaggagagagaagacagagagaccagcagagagacgcagcgcgagacgaggagagcaacagagcagcgaacagaagtaagcagcgagagccgaggcgacgagcaacaccaacgcagcgacgcgaccacgcagagacgcggaagtgcgaccagactgcgggagtaggtgggaagaggagtgggatcagacaggccatcgtccaggtccgagtcatgtaacgctcgagacagaagcagcgagctgcaccaacacgagacaaagaagaaacaccgccagaagagtagaagcagagcaagacagaacataagcgggcagtaaacaaactcaagaacagcaaataaacaacagcgtaacagtcgagggagacagaagaacgagacgaaaagacatgaagacaatagatccgagactaggagggaacagagaacgataacagaaaagagctgagcaaaggcgatgagaaaaagacgaaacagacaaagaccaatctaaatacaggagccaagacaacaagacaagaaaacaatacaagggaaaagtggcaggaagaagatgaagcgaagatgaaccgaaagaagacataagagccaagaaactgcaaccaaggaaaagacagacacgaagagacacagcaaaataaacaaaaaagaaaaag

SEQ ID NO: 435876 - DNA, 961 bp, Homo sapiens
gtgcgcggagaacacaaagtaaaacttctgctgttcccagtcctgcagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttatgtataaaagcatatgtgctactcatctttgctcactatgcagtcttttttaagagagcagagagtatcagatgtacaattatggaaataagaacattacttgagcatgacacttctttcagtatattgcttgatgcttcaaataaagttttgtcttgggaa

SEQ ID NO: 435877 - DNA, 3318 bp, Homo sapiens
agcggacagatctctggcggcggcaaggggacagcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccaccttccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcaagggagtgagttgatagcacagaccctgccctgtgggcccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaagacgctgtgctgccctgcccacctggcctctgcactcccctgctgggtgtggcgcagcatattcaggaagctcagggcctggctcaggtggggtcactctggcagctcagagagggtgggagtgggtccaatgcactttgttctggctcttccaggctgggagagcctttcaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtgaaaaaaaaaaa

SEQ ID NO: 435878 - DNA, 1622 bp, Homo sapiens
agcggacagatctctggcggcggcaaggggacagcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccaccttccagggacagagggggtggcctcccaactcaccccagccccaaaactctcctctgctgctggctggttagaggttccctttgacgccatcccagccccaatgaacaattatttattaaatgcccagccccttctg

SEQ ID NO: 435879 - DNA, 3307 bp, Homo sapiens
agcggacagatctctggcggcggcaaggggacagcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccaccttccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcaagggagtgagttgatagcacagaccctgccctgtgggcccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaagacgctgtgctgccctgcccacctggcctctgcactcccctgctgggtgtggcgcagcatattcaggaagctcagggcctggctcaggtggggtcactctggcagctcagagagggtgggagtgggtccaatgcactttgttctggctcttccaggctgggagagcctttcaggggtgggacaccctgtgatggggccctgcctcctttgtgaggaagccgctggggccagttggtcccccttccatggactttgttagtttctccaagcaggacatggacaaggatgatctaggaagactttggaaagagtaggcaccctctgccatgccagctccctccccaacccccaacgtcgggtggtaagcgacatggctttaatgattttcgacttttcttt

SEQ ID NO: 435880 - DNA, 2083 bp, Homo sapiens
agcggacagatctctggcggcggcaaggggacagcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccaccttccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgccctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtgaaaaaaaaaaa

SEQ ID NO: 435881 - DNA, 546 bp, Homo sapiens
tatcaacagaaccaggcatcatgcggcaaacgcgcaatcatgtaggtactgccctcgaggcctctgaaatcccctttgggcccttggaatattcccagacctctgagaatctacgtccacacctccgctcccagacctgggctcccagccaaaggcctcagcacacgcttctcttgcccctggcctgcaggccacctcactgaccttaatttctgtgccacatggctaaggtggagagtggcttcctgaatggcccagtgtggctgggtggcagccaccctggcttgtggcctggagcagccatgaagggtggtaattcctcctgggctgaagcacatgttaccccacactcgaacccactatatttcatggggcggtgtgggtaggtgtaaagcatgagggtcttacttaaaatgcaggttccagactctaacagacctgatgcaaatcctgccttccctcttactggctgggtggccctgcttccattgcttactttttgcaacttggtttccttgtctgtaaaatgggtagctaggacaggat

SEQ ID NO: 435882 - DNA, 2073 bp, Homo sapiens
gactccgcctgggtcgctgactccgcgcggccgggcgggagggaggtcgaggaggccgctcgcacaaagccgcggaccgctgccccctctccccgccccctgcccggccaacgccgaagtgcggagagcagccgcgggccctttaagggccgcgaggtgcgcggtctctttaaggcgggtcctggtggtttctgttttctgaaggaagtgacggggggtgggattgaatgaaaagtgcaaaacacaggctcgcagcgctggagcccggggccgcggagccgggccggggcagcgccgtctccgcctcggggccgccgggggcgccctgctgagcgctacccacgtgcgtccgcgccacctcgcgggcgaccccgcggccaaggcccccggcggagcggctcccgggcgccccgaactagcccccaactttgggcgaagtttgcctgcgcctctccccgcccccacgcggcgcgccggggccgcggacggcagcggcccccggggatgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccgcgggaagccctgcgtctgccactatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagacccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagttttttacttga

SEQ ID NO: 435883 - DNA, 2463 bp, Homo sapiens
gactccgcctgggtcgctgactccgcgcggccgggcgggagggaggtcgaggaggccgctcgcacaaagccgcggaccgctgccccctctccccgccccctgcccggccaacgccgaagtgcggagagcagccgcgggccctttaagggccgcgaggtgcgcggtctctttaaggcgggtcctggtggtttctgttttctgaaggaagtgacggggggtgggattgaatgaaaagtgcaaaacacaggctcgcagcgctggagcccggggccgcggagccgggccggggcagcgccgtctccgcctcggggccgccgggggcgccctgctgagcgctacccacgtgcgtccgcgccacctcgcgggcgaccccgcggccaaggcccccggcggagcggctcccgggcgccccgaactagcccccaactttgggcgaagtttgcctgcgcctctccccgcccccacgcggcgcgccggggccgcggacggcagcggcccccggggatgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccgcgggaagccctgcgtctgccactatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagacccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagttttttacttgactaatgagacccagagtttggagaaaacttttggccaatgctgccacctgatgtcagaaagtgtccccacaccctagcagtggcctatcttggaacaagaacttcgaaagcacctactgtgtgctcagccatttgaggaaggaaggaggagaaggaagatgttactagggaaggatgagataaaacttctgcacccaagacaatgagacagacatagctgcaaccgtagtaagccagtcagaaatagccagcgcgaaggcaagagatggggtggagattggaaccccgcttcagatctgggctcggctacttacctgctgtgcagccatgggtcaagttgcttgacctctctgtgcctccactcccttagctataaaatgagcttactta

SEQ ID NO: 435884 - DNA, 2364 bp, Homo sapiens
gactccgcctgggtcgctgactccgcgcggccgggcgggagggaggtcgaggaggccgctcgcacaaagccgcggaccgctgccccctctccccgccccctgcccggccaacgccgaagtgcggagagcagccgcgggccctttaagggccgcgaggtgcgcggtctctttaaggcgggtcctggtggtttctgttttctgaaggaagtgacggggggtgggattgaatgaaaagtgcaaaacacaggctcgcagcgctggagcccggggccgcggagccgggccggggcagcgccgtctccgcctcggggccgccgggggcgccctgctgagcgctacccacgtgcgtccgcgccacctcgcgggcgaccccgcggccaaggcccccggcggagcggctcccgggcgccccgaactagcccccaactttgggcgaagtttgcctgcgcctctccccgcccccacgcggcgcgccggggccgcggacggcagcggcccccggggatgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccgcgggaagccctgcgtctgccactatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagacccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagttttttacttgaaaaaaagaaaagaaaagaagaaataaaaagaaagaaagaaaaagaaagacaaaaaaaaaaaaagaaaaaaaggggggggcgaacgaaaaagattcacaccaagagggggcccctgcacaagggcaccacccggggggagggagcaacggggggacccccacaagtaggtcaacgccataaacaatggacggcaggcaaggcgggggcggagttaacaaaccgaaggagcagggggaaaaggcggggacagagagggagacgaggagagaagacacgtacgaagaggggcga

SEQ ID NO: 435885 - DNA, 1460 bp, Homo sapiens
agaaagagaagtaatgaggaaggagaagaggacgacacaggaaagatgaggaggaggaggaggaggaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccgcgggaagccctgcgtctgccactatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagttttttacttga

SEQ ID NO: 435886 - DNA, 2471 bp, Homo sapiens
gactccgcctgggtcgctgactccgcgcggccgggcgggagggaggtcgaggaggccgctcgcacaaagccgcggaccgctgccccctctccccgccccctgcccggccaacgccgaagtgcggagagcagccgcgggccctttaagggccgcgaggtgcgcggtctctttaaggcgggtcctggtggtttctgttttctgaaggaagtgacggggggtgggattgaatgaaaagtgcaaaacacaggctcgcagcgctggagcccggggccgcggagccgggccggggcagcgccgtctccgcctcggggccgccgggggcgccctgctgagcgctacccacgtgcgtccgcgccacctcgcgggcgaccccgcggccaaggcccccggcggagcggctcccgggcgccccgaactagcccccaactttgggcgaagtttgcctgcgcctctccccgcccccacgcggcgcgccggggccgcggacggcagcggcccccggggatgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccgcgggaagccctgcgtctgccactatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctggcccctcagtcccttcctactccccaacaaggggctcactatccccaaagaaggagctgttggggacccacgacgcagcccctgtactggattacagcatattccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagttttttacttgactaatgagacccagagtttggagaaaacttttggccaatgctgccacctgatgtcagaaagtgtccccacaccctagcagtggcctatcttggaacaagaacttcgaaagcacctactgtgtgctcagccatttgaggaaggaaggaggagaaggaagatgttactagggaaggatgagataaaacttctgcacccaagacaatgagacagacatagctgcaaccgtagtaagccagtcagaaatagccagcgcgaaggcaagagatggggtggagattggaaccccgcttcagatctgggctcggctacttacctgctgtgcagccatgggtcaagttgcttgacctctctgtgcctccactcccttagctataaaatgagcttactta

SEQ ID NO: 435887 - DNA, 2478 bp, Homo sapiens
  misc_feature (1833)..(1833): n is a, c, g, or t
tacagtggttcagacctccacccaggtttctaaagtctgattttcaggttagcctctgacccagaagctaccatttcatacccacctctggcatctccaatttcatcagcaagggagggaattgggagtggaagacaccgaaaggaaaccagctttcccaagtccctttaactccaggtttctccattggcctaggacggggtggagttggagagtgcagtgtgggggagaatagccttaccctcacccaggccactcactcactgcctgcactggccacagcagcttctatgtccagatccttctagggtgggtcacctctcagttctcaaggccccatgcctcatagtgtttgtcagatttccataagaaagtttggtctagaaggaatgatttttcctataagaaaaagacttcggctcggtgtggtggctcacatctgtaatcccaggatttggggaggctgaggcaggcttatcgcttgaaaccaggaatatgaaatcttcaggccaaacgagacccctgtctctacaaaaaatttaaaaattagcggagcacgctggtgtgtgccttgtagtcccagctattcaaggaggctggaaaaaaccttggtgcagaggaacaaatccacagagaccctcgtttgtacagacttgggctggaccacttcccccacgctcttacctccagtggatggagtgttggctacttggccatgcctgcaactcctctctcccctgcatggcctcttggggagctgggtgagggggatgagtttggaaaatatctcaccaaggccaggtgtggtggctcatgcctataatcccagcattttgggaggccgaggcaggcggattacttgaggccaggagttcgagaccagcctgatcaacatggtgaaaccctgtccctactgaaaatacaaaaattagccaggcatggtggtgtgtgcctataatttcagctactctggaggctgaggcgggagaatcacttgaaccggggaggcagaggttgcagtgagccgagatcacgccgttgcactccagcctgggcaacagagtgagactccatctcaaaaaaaaagaaaagaaaatatctcacagacactagtgagcaatcactatgtacgttttttcctgccacttacccactgtgtgacttggcaagtcacttaacctctctgagccccaggctccttgccggtacaccagagacaacagtgtgatgcttggggttcagtgtgcgcagtgactaagaggcccttcgcagaacagaggcccgcgtgggcatgtgaggagtgaggtgccagtgcccgcttggatgtccgtctaccccaccgttaagcatgttgctgcagctgctgcttttctgctgtagggaccaaagcatcatgaggagctaacatccttgaagttggcaagtgttgaagtggctgccactagggattcagataaagggcagggagaggcatcagggctgggagtgcgggtgagagggaagcatggagacccgtctcaggagcactgagtcagcagcacagtggggcgcagttgatccacataaagcctcacattgttcctgcagcagtcaggacagtggtgacctttgggattcggctgacaactgctctggggaggggctgggggcaggagcactgctctgggtgagtggttgtgctaatgccccaagacaagcagcctctgtccaggcctagccctgaggggatgctggcatctcatcatggggcggcctaggtccctgggcactggcctcgggatgtgcgtggcctggctctgggtggaatccatccacccccgttcctgctcgagnagcctgggcagagcagccagggtgcttccagctttgccgtggggctaggaaggcactgcttcctggctggctctgcaggctaaaccccctctcccctccccagcccagcgaagccagccacttctctagccataaagcagccccagccaggagcactgagtcagcagcacagtggggcgcagttgatccacataaagcctcacattgttcctgcagcagtcaggacagtggtgacctttgggattcggctgacagagcactgctctggggaggggctgggggcaggagcactgctctgggtgagtggttgtgctaatgccccaagacaagcagcctctgtccaggcctagccctgaggggatgctggcatctcatcatggggcggcctaggtccctaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagttttttacttga

SEQ ID NO: 435888 - DNA, 2477 bp, Homo sapiens
  misc_feature (1832)..(1832): n is a, c, g, or t
tacagtggttcagacctccacccaggtttctaaagtctgattttcaggttagcctctgacccagaagctaccatttcatacccacctctggcatctccaatttcatcagcaagggagggaattgggagtggaagacaccgaaaggaaaccagctttcccaagtccctttaactccaggtttctccattggcctaggacggggtggagttggagagtgcagtgtgggggagaatagccttaccctcacccaggccactcactcactgcctgcactggccacagcagcttctatgtccagatccttctagggtgggtcacctctcagttctcaaggccccatgcctcatagtgtttgtcagatttccataagaaagtttggtctagaaggaatgatttttcctataagaaaaagacttcggctcggtgtggtggctcacatctgtaatcccaggatttggggaggctgaggcaggcttatcgcttgaaaccaggaatatgaaatcttcaggccaaacgagacccctgtctctacaaaaaatttaaaaattagcggagcacgctggtgtgtgccttgtagtcccagctattcaaggaggctggaaaaaaccttggtgcagaggaacaaatccacagagaccctcgtttgtacagacttgggctggaccacttcccccacgctcttacctccagtggatggagtgttggctacttggccatgcctgcaactcctctctcccctgcatggcctcttggggagctgggtgagggggatgagtttggaaaatatctcaccaaggccaggtgtggtggctcatgcctataatcccagcattttgggaggccgaggcaggcggattacttgaggccaggagttcgagaccagcctgatcaacatggtgaaaccctgtccctactgaaaatacaaaaattagccaggcatggtggtgtgtgcctataatttcagctactctggaggctgaggcgggagaatcacttgaaccggggaggcagaggttgcagtgagccgagatcacgccgttgcactccagcctgggcaacagagtgagactccatctcaaaaaaaaagaaaagaaaatatctcacagacactagtgagcaatcactatgtacgttttttcctgccacttacccactgtgtgacttggcaagtcacttaacctctctgagccccaggctccttgccggtacaccagagacaacagtgtgatgcttggggttcagtgtgcgcagtgactaagaggcccttcgcagaacagaggcccgcgtgggcatgtgaggagtgaggtgccagtgcccgcttggatgtccgtctaccccaccgttaagcatgttgctgcagctgctgcttttctgctgtagggaccaaagcatcatgaggagctaacatccttgaagttggcaagtgttgaagtggctgccactagggattcagataaagggcagggagaggcatcagggctgggagtgcgggtgagagggaagcatggagacccgtctcaggagcactgagtcagcagcacagtggggcgcagttgatccacataaagcctcacattgttcctgcagcagtcaggacagtggtgacctttgggattcggctgacagagcactgctctggggaggggctgggggcaggagctctgggtgagtggttgtgctaatgccccaagacaagcagcctctgtccaggcctagccctgaggggatgctggcatctcatcatggggcggcctaggtccctgggcactggcctcgggatgtgcgtggcctggctctgggtggaatccatccacccccgttcctgctcgagnagcctgggcagagcagccagggtgcttccagctttgccgtggggctaggaaggcactgcttcctggctggctctgcaggctaaaccccctctcccctccccagcccagcgaagccagccacttctctagccataaagcagccccagccaggagcactgagtcagcagcacagtggggcgcagttgatccacataaagcctcacattgttcctgcagcagtcaggacagtggtgacctttgggattcggctgacagagcactgctctggggaggggctgggggcaggagcactgctctgggtgagtggttgtgctaatgccccaagacaagcagcctctgtccaggcctagccctgaggggatgctggcatctcatcatggggcggcctaggtccctaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagttttttacttga

SEQ ID NO: 435889 - DNA, 733 bp, Homo sapiens
tcactgacatggggctcctgggtctaatatctgtccctcctctgcgtgtgaggaattcctcctcagatcaggatggccagccctgcctgagggttcagaccccctcccgggagcttggccagcatctcccacccctgaatgctatgtccaggtggagtcctagcaaaagatcccggtaggccatgaagactgccacctgggataatggaggatcctgctgggaagctggtggggagagtgagttagttccctcccaggcttcccaaggcacagagaggtggtggagataaacttaggacagactcctgttccgctggcggagggcccagccttgaagtgaggattgcatagggtctggagatcacccattgagcagtccctcatgtcacacatgctcttatctgatcgcctggagctctcaagtgaggctgacaagatgaagcagctgatgatcccagattaggacccagggttccttccagtatatcctgactgcctgtctgccatggtaccatgagtgggctccttccagtaggctaaagaaccctggggagggaggtggaggggagaaggaggctggaaaaaaccttggtgcagaggaacaaatccacagagaccctcgtttgtacagacttgggctggaccacttcccccacgctcttacctccagtggatggagtgttggctacttggccatgcctgcaactcctctctcccctgcatggcctcttgg

SEQ ID NO: 435890 - DNA, 2126 bp, Homo sapiens
gactccgcctgggtcgctgactccgcgcggccgggcgggagggaggtcgaggaggccgctcgcacaaagccgcggaccgctgccccctctccccgccccctgcccggccaacgccgaagtgcggagagcagccgcgggccctttaagggccgcgaggtgcgcggtctctttaaggcgggtcctggtggtttctgttttctgaaggaagtgacggggggtgggattgaatgaaaagtgcaaaacacaggctcgcagcgctggagcccggggccgcggagccgggccggggcagcgccgtctccgcctcggggccgccgggggcgccctgctgagcgctacccacgtgcgtccgcgccacctcgcgggcgaccccgcggccaaggcccccggcggagcggctcccgggcgccccgaactagcccccaactttgggcgaagtttgcctgcgcctctccccgcccccacgcggcgcgccggggccgcggacggcagcggcccccggggatgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccgcgggaagccctgcgtctgccactatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagttttttacttga

SEQ ID NO: 435891 - DNA, 1980 bp, Homo sapiens
gactccgcctgggtcgctgactccgcgcggccgggcgggagggaggtcgaggaggccgctcgcacaaagccgcggaccgctgccccctctccccgccccctgcccggccaacgccgaagtgcggagagcagccgcgggccctttaagggccgcgaggtgcgcggtctctttaaggcgggtcctggtggtttctgttttctgaaggaagtgacggggggtgggattgaatgaaaagtgcaaaacacaggctcgctcccgggcgccccgaactagcccccaactttgggcgaagtttgcctgcgcctctccccgcccccacgcggcgcgccggggccgcggacggcagcggcccccggggatgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccgcgggaagccctgcgtctgccactatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagttttttacttga

SEQ ID NO: 435892 - DNA, 2042 bp, Homo sapiens
gactccgcctgggtcgctgactccgcgcggccgggcgggagggaggtcgaggaggccgctcgcacaaagccgcggaccgctgccccctctccccgccccctgcccggccaacgccgaagtgcggagagcagccgcgggccctttaagggccgcgaggtgcgcggtctctttaaggcgggtcctggtggtttctgttttctgaaggaagtgacggggggtgggattgaatgaaaagtgcaaaacacaggctcgcagcgctggagcccggggccgcggagccgggccggggcagcgccgtctccgcctcggggccgccgggggcgccctgctgagcgctacccacgtgcgtccgcgccacctcgcgggcgaccccgcggccaaggcccccggcggagcggctcccgggcgccccgaactagcccccaactttgggcgaagtttgcctgcgcctctccccgcccccacgcggcgcgccggggccgcggacggcagcggcccccggggatgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccgcgggaagccctgcgtctgccactatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagttttttacttga

SEQ ID NO: 435893 - DNA, 1096 bp, Homo sapiens
cttgcctctctccacccgacggtgtggacagttctgtgttcgaggctctgcccaaggcctcagagcaggcggagctgcctcgctgcaggcaggtgggggaccgcgggaagccctgcgtctgccactatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctagacagaaatatttttgtaaggttctggggcagggagggagcatgaagtacgaggaaaacttgaattccagatttttaatgcaaagtatttatcatttctaccagaaataaacgttttaagttttttacttga

SEQ ID NO: 435894 - DNA, 124 bp, Homo sapiens
ctcggtctcagtctcctctgaactctcaacttaaagccttgactctggattctatcattcttgttaaagtatcgggtctaggctttaagttgagagttcagagggagactggggaaggtggagg

SEQ ID NO: 435895 - DNA, 1777 bp, Homo sapiens
ccttcacctcactttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgct

SEQ ID NO: 435896 - DNA, 1800 bp, Homo sapiens
cagcacagagagcaaaagaatacgctagtacaggctccggttattcggccgaggcaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgct

SEQ ID NO: 435897 - DNA, 1775 bp, Homo sapiens
aaacgggggctagggagcgagggccccgtgcgcgtgttaaaaactctggcaccgaaggtgagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgct

SEQ ID NO: 435898 - DNA, 1766 bp, Homo sapiens
caaacctaatcggctagggacgaggccggggtgtttaatcggcaccgagggagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgct

SEQ ID NO: 435899 - DNA, 1912 bp, Homo sapiens
cccttgcacacccacagggtagacggatcgagtttcagcttaaaccgaggggtgtgggggaagggtgttgggttcagctagtccacgtgggtgctgtcctccacttggtgctgaaatctgggcggccacatccccggggcgggagggggctacatccccggctttagacgcgcgagtctcaggtcccgctaattacctggcgggtgctgcccacccctgccctcgcgcacctagcgcggtggcaggcgggaaggcggggcctgggggagccccacccctggagactgcggctggggcctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 435900 - DNA, 1808 bp, Homo sapiens
ccttcacctcactttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgctgcagctgtctgtgttacttctaatggtgggg

SEQ ID NO: 435901 - DNA, 1642 bp, Homo sapiens
ccttcacctcactttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgct

SEQ ID NO: 435902 - DNA, 3574 bp, Homo sapiens
cccttgcacacccacagggtagacggatcgagtttcagcttaaaccgaggggtgtgggggaagggtgttgggttcagctagtccacgtgggtgctgtcctccacttggtgctgaaatctgggcggccacatccccggggcgggagggggctacatccccggctttagacgcgcgagtctcaggtcccgctaattacctggcgggtgctgcccacccctgccctcgcgcacctagcgcggtggcaggcgggaaggcggggcctgggggagccccacccctggagactgcggctggggcctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttagagaagactatgtaggggagctaggtgggaggacataaggaaaaccaaagagtagcataaatagattatgtaatttaccaaccaacccaggacatgtcttatagtaaaaaggactatctaggactcactccaggactaaaggtgtaaaccagctgggaccatactgggaaaaccaggacatgtggtcacactaagattaggaaaagaaagagtgtcaggaatcttaggaagtgaacaaggctgttgacagagagtgcaaagaaggaataaatgagatggcacgtcagtgcctgggatgtgtgcagtgggatggtgaggtgtgcagataaggaaaacattcgagcttagattgatgttggcggggagaggttgctgtgttcatgactctaatataaccacccagttctgagacaaggtaggccttgactctggattctatcattcttgttaaagtatcgggtctaggctttaagttgagagttcggagagagactggggaaggtggaggatagaatggttcaagttctagaatatgtggctctagatgagaggttgaactgaatcatcaatcctacatggattgggtctccgtattcaagtctacattagaaatccccataaactcaattcaattcttactgtatgttctcaaacatacagttctattttaggtttgcaaagaaaaagagctcctcttttagattctgagaagtttctactatttttggcaagtaatagataacatattctgactatgagtgggtagggaagtacctttaaattatatgcctcagtttcctcatctgtaaaattgggataatgagattttctacattttaggttgttgtggggattaagtgaaatacaggtaaagtacttggtccacagtaagtgcttaataagtgttaaagtgttagctgcaatattattctggatggaagagtttccccccatgttcagcacataagatatccctggtggcatggttccttctgaactacaaacaggatccctttactcatgttggatagtggtctttgtgatcatcactctgctagatcccttgtctcttgaactctaatagtcatcttcatgactacatggttaagtggaagccaaatgccttccccctgtcccctattcctatgaatctggctttcctgctctgttttcatctttctctgcattcacacaggtgctccgttcacagctaacagaatgttatcttacctcttcctggcaaagcttacaccttcatcttctgtctgaagggacccttctaagctctaggctcattagcaaagcaaagataatcgatgcatgcagacctcattgaataatcagtcatctctcagttcagtttaccacctctgttcatttccctagatcatccttaatacaccactccttcgagttttcttcttccacataagatattttttcacaatctcattattatgcacatcataattttgcatcatgcatgcatgaaaacaataacaaacctttttcatttaaaaaaagaccaatgtcattcattcacagccaagtttctgttctagacatatttctagtgttcttgtgggtctagctaagggagggtccagggttaatgaaatatccctgatttttcgttaacaaaacctttgtggactcaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 435903 - DNA, 1609 bp, Homo sapiens
  misc_feature (9)..(9): n is a, c, g, or t
attggctgngaggcgggggtaatcggcacgagggcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 435904 - DNA, 3530 bp, Homo sapiens
cccttgcacacccacagggtagacggatcgagtttcagcttaaaccgaggggtgtgggggaagggtgttgggttcagctagtccacgtgggtgctgtcctccacttggtgctgaaatctgggcggccacatccccggggcgggagggggctacatccccggctttagacgcgcgagtctcaggtcccgctaattacctggcgggtgctgcccacccctgccctcgcgcacctagcgcggtggcaggcgggaaggcggggcctgggggagccccacccctggagactgcggctggggcctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttagagaagactatgtaggggagctaggtgggaggacataaggaaaaccaaagagtagcataaatagattatgtaatttaccaaccaacccaggacatgtcttatagtaaaaaggactatctaggactcactccaggactaaaggtgtaaaccagctgggaccatactgggaaaaccaggacatgtggtcacactaagattaggaaaagaaagagtgtcaggaatcttaggaagtgaacaaggctgttgacagagagtgcaaagaaggaataaatgagatggcacgtcagtgcctgggatgtgtgcagtgggatggtgaggtgtgcagataaggaaaacattcgagcttagattgatgttggcggggagaggttgctgtgttcatgactctaatataaccacccagttctgagacaaggtaggccttgactctggattctatcattcttgttaaagtatcgggtctaggctttaagttgagagttcggagagagactggggaaggtggaggatagaatggttcaagttctagaatatgtggctctagatgagaggttgaactgaatcatcaatcctacatggattgggtctccgtattcaagtctacattagaaatccccataaactcaattcaattcttactgtatgttctcaaacatacagttctattttaggtttgcaaagaaaaagagctcctcttttagattctgagaagtttctactatttttggcaagtaatagataacatattctgactatgagtgggtagggaagtacctttaaattatatgcctcagtttcctcatctgtaaaattgggataatgagattttctacattttaggttgttgtggggattaagtgaaatacaggtaaagtacttggtccacagtaagtgcttaataagtgttaaagtgttagctgcaatattattctggatggaagagtttccccccatgttcagcacataagatatccctggtggcatggttccttctgaactacaaacaggatccctttactcatgttggatagtggtctttgtgatcatcactctgctagatcccttgtctcttgaactctaatagtcatcttcatgactacatggttaagtggaagccaaatgccttccccctgtcccctattcctatgaatctggctttcctgctctgttttcatctttctctgcattcacacaggtgctccgttcacagctaacagaatgttatcttacctcttcctggcaaagcttacaccttcatcttctgtctgaagggacccttctaagctctaggctcattagcaaagcaaagataatcgatgcatgcagacctcattgaataatcagtcatctctcagttcagtttaccacctctgttcatttccctagatcatccttaatacaccactccttcgagttttcttcttccacataagatattttttcacaatctcattattatgcacatcataattttgcatcatgcatgcatgaaaacaataacaaacctttttcatttaaaaaaagaccaatgtcattcattcacagccaagtttctgttctagacatatttctagtgttcttgtgggtctagctaagggagggtccagggttaatgaaatatccctgatttttcgttaacaaaacctttgtggactcaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 435905 - DNA, 3375 bp, Homo sapiens
cccttgcacacccacagggtagacggatcgagtttcagcttaaaccgaggggtgtgggggaagggtgttgggttcagctagtccacgtgggtgctgtcctccacttggtgctgaaatctgggcggccacatccccggggcgggagggggctacatccccggctttagacgcgcgagtctcaggtcccgctaattacctggcgggtgctgcccacccctgccctcgcgcacctagcgcggtggcaggcgggaaggcggggcctgggggagccccacccctggagactgcggctggggcctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttagagaagactatgtaggggagctaggtgggaggacataaggaaaaccaaagagtagcataaatagattatgtaatttaccaaccaacccaggacatgtcttatagtaaaaaggactatctaggactcactccaggactaaaggtgtaaaccagctgggaccatactgggaaaaccaggacatgtggtcacactaagattaggaaaagaaagagtgtcaggaatcttaggaagtgaacaaggctgttgacagagagtgcaaagaaggaataaatgagatggcacgtcagtgcctgggatgtgtgcagtgggatggtgaggtgtgcagataaggaaaacattcgagcttagattgatgttggcggggagaggttgctgtgttcatgactctaatataaccacccagttctgagacaaggtaggccttgactctggattctatcattcttgttaaagtatcgggtctaggctttaagttgagagttcggagagagactggggaaggtggaggatagaatggttcaagttctagaatatgtggctctagatgagaggttgaactgaatcatcaatcctacatggattgggtctccgtattcaagtctacattagaaatccccataaactcaattcaattcttactgtatgttctcaaacatacagttctattttaggtttgcaaagaaaaagagctcctcttttagattctgagaagtttctactatttttggcaagtaatagataacatattctgactatgagtgggtagggaagtacctttaaattatatgcctcagtttcctcatctgtaaaattgggataatgagattttctacattttaggttgttgtggggattaagtgaaatacaggtaaagtacttggtccacagtaagtgcttaataagtgttaaagtgttagctgcaatattattctggatggaagagtttccccccatgttcagcacataagatatccctggtggcatggttccttctgaactacaaacaggatccctttactcatgttggatagtggtctttgtgatcatcactctgctagatcccttgtctcttgaactctaatagtcatcttcatgactacatggttaagtggaagccaaatgccttccccctgtcccctattcctatgaatctggctttcctgctctgttttcatctttctctgcattcacacaggtgctccgttcacagctaacagaatgttatcttacctcttcctggcaaagcttacaccttcatcttctgtctgaagggacccttctaagctctaggctcattagcaaagcaaagataatcgatgcatgcagacctcattgaataatcagtcatctctcagttcagtttaccacctctgttcatttccctagatcatccttaatacaccactccttcgagttttcttcttccacataagatattttttcacaatctcattattatgcacatcataattttgcatcatgcatgcatgaaaacaataacaaacctttttcatttaaaaaaagaccaatgtcattcattcacagccaagtttctgttctagacatatttctagtgttcttgtgggtctagctaagggagggtccagggttaatgaaatatccctgatttttcgttaacaaaacctttgtggactcaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 435906 - DNA, 3364 bp, Homo sapiens
  misc_feature (9)..(9): n is a, c, g, or t
attggctgngaggcgggggtaatcggcacgagggcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagccagacatggccaactggacagctcccaggtaactgcactaggtctaggcgtctgtgccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttagagaagactatgtaggggagctaggtgggaggacataaggaaaaccaaagagtagcataaatagattatgtaatttaccaaccaacccaggacatgtcttatagtaaaaaggactatctaggactcactccaggactaaaggtgtaaaccagctgggaccatactgggaaaaccaggacatgtggtcacactaagattaggaaaagaaagagtgtcaggaatcttaggaagtgaacaaggctgttgacagagagtgcaaagaaggaataaatgagatggcacgtcagtgcctgggatgtgtgcagtgggatggtgaggtgtgcagataaggaaaacattcgagcttagattgatgttggcggggagaggttgctgtgttcatgactctaatataaccacccagttctgagacaaggtaggccttgactctggattctatcattcttgttaaagtatcgggtctaggctttaagttgagagttcggagagagactggggaaggtggaggatagaatggttcaagttctagaatatgtggctctagatgagaggttgaactgaatcatcaatcctacatggattgggtctccgtattcaagtctacattagaaatccccataaactcaattcaattcttactgtatgttctcaaacatacagttctattttaggtttgcaaagaaaaagagctcctcttttagattctgagaagtttctactatttttggcaagtaatagataacatattctgactatgagtgggtagggaagtacctttaaattatatgcctcagtttcctcatctgtaaaattgggataatgagattttctacattttaggttgttgtggggattaagtgaaatacaggtaaagtacttggtccacagtaagtgcttaataagtgttaaagtgttagctgcaatattattctggatggaagagtttccccccatgttcagcacataagatatccctggtggcatggttccttctgaactacaaacaggatccctttactcatgttggatagtggtctttgtgatcatcactctgctagatcccttgtctcttgaactctaatagtcatcttcatgactacatggttaagtggaagccaaatgccttccccctgtcccctattcctatgaatctggctttcctgctctgttttcatctttctctgcattcacacaggtgctccgttcacagctaacagaatgttatcttacctcttcctggcaaagcttacaccttcatcttctgtctgaagggacccttctaagctctaggctcattagcaaagcaaagataatcgatgcatgcagacctcattgaataatcagtcatctctcagttcagtttaccacctctgttcatttccctagatcatccttaatacaccactccttcgagttttcttcttccacataagatattttttcacaatctcattattatgcacatcataattttgcatcatgcatgcatgaaaacaataacaaacctttttcatttaaaaaaagaccaatgtcattcattcacagccaagtttctgttctagacatatttctagtgttcttgtgggtctagctaagggagggtccagggttaatgaaatatccctgatttttcgttaacaaaacctttgtggactcaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 435907 - DNA, 2723 bp, Homo sapiens
  misc_feature (46)..(46): n is a, c, g, or t
  misc_feature (54)..(55): n is a, c, g, or t
tttcgcctagtttcccggtttcgccatgtttcctggtttcgccatntttcccanngagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttagagaagactatgtaggggagctaggtgggaggacataaggaaaaccaaagagtagcataaatagattatgtaatttaccaaccaacccaggacatgtcttatagtaaaaaggactatctaggactcactccaggactaaaggtgtaaaccagctgggaccatactgggaaaaccaggacatgtggtcacactaagattaggaaaagaaagagtgtcaggaatcttaggaagtgaacaaggctgttgacagagagtgcaaagaaggaataaatgagatggcacgtcagtgcctgggatgtgtgcagtgggatggtgaggtgtgcagataaggaaaacattcgagcttagattgatgttggcggggagaggttgctgtgttcatgactctaatataaccacccagttctgagacaaggtaggccttgactctggattctatcattcttgttaaagtatcgggtctaggctttaagttgagagttcggagagagactggggaaggtggaggatagaatggttcaagttctagaatatgtggctctagatgagaggttgaactgaatcatcaatcctacatggattgggtctccgtattcaagtctacattagaaatccccataaactcaattcaattcttactgtatgttctcaaacatacagttctattttaggtttgcaaagaaaaagagctcctcttttagattctgagaagtttctactatttttggcaagtaatagataacatattctgactatgagtgggtagggaagtacctttaaattatatgcctcagtttcctcatctgtaaaattgggataatgagattttctacattttaggttgttgtggggattaagtgaaatacaggtaaagtacttggtccacagtaagtgcttaataagtgttaaagtgttagctgcaatattattctggatggaagagtttccccccatgttcagcacataagatatccctggtggcatggttccttctgaactacaaacaggatccctttactcatgttggatagtggtctttgtgatcatcactctgctagatcccttgtctcttgaactctaatagtcatcttcatgactacatggttaagtggaagccaaatgccttccccctgtcccctattcctatgaatctggctttcctgctctgttttcatctttctctgcattcacacaggtgctccgttcacagctaacagaatgttatcttacctcttcctggcaaagcttacaccttcatcttctgtctgaagggacccttctaagctctaggctcattagcaaagcaaagataatcgatgcatgcagacctcattgaataatcagtcatctctcagttcagtttaccacctctgttcatttccctagatcatccttaatacaccactccttcgagttttcttcttccacataagatattttttcacaatctcattattatgcacatcataattttgcatcatgcatgcatgaaaacaataacaaacctttttcatttaaaaaaagaccaatgtcattcattcacagccaagtttctgttctagacatatttctagtgttcttgtgggtctagctaagggagggtccagggttaatgaaatatccctgatttttcgttaacaaaacctttgtggactcaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 435908 - DNA, 2775 bp, Homo sapiens
gaaatcaatgcacaattgaagtctggggagggattccctctccttaaccatctctccctcttaactccccttaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttagagaagactatgtaggggagctaggtgggaggacataaggaaaaccaaagagtagcataaatagattatgtaatttaccaaccaacccaggacatgtcttatagtaaaaaggactatctaggactcactccaggactaaaggtgtaaaccagctgggaccatactgggaaaaccaggacatgtggtcacactaagattaggaaaagaaagagtgtcaggaatcttaggaagtgaacaaggctgttgacagagagtgcaaagaaggaataaatgagatggcacgtcagtgcctgggatgtgtgcagtgggatggtgaggtgtgcagataaggaaaacattcgagcttagattgatgttggcggggagaggttgctgtgttcatgactctaatataaccacccagttctgagacaaggtaggccttgactctggattctatcattcttgttaaagtatcgggtctaggctttaagttgagagttcggagagagactggggaaggtggaggatagaatggttcaagttctagaatatgtggctctagatgagaggttgaactgaatcatcaatcctacatggattgggtctccgtattcaagtctacattagaaatccccataaactcaattcaattcttactgtatgttctcaaacatacagttctattttaggtttgcaaagaaaaagagctcctcttttagattctgagaagtttctactatttttggcaagtaatagataacatattctgactatgagtgggtagggaagtacctttaaattatatgcctcagtttcctcatctgtaaaattgggataatgagattttctacattttaggttgttgtggggattaagtgaaatacaggtaaagtacttggtccacagtaagtgcttaataagtgttaaagtgttagctgcaatattattctggatggaagagtttccccccatgttcagcacataagatatccctggtggcatggttccttctgaactacaaacaggatccctttactcatgttggatagtggtctttgtgatcatcactctgctagatcccttgtctcttgaactctaatagtcatcttcatgactacatggttaagtggaagccaaatgccttccccctgtcccctattcctatgaatctggctttcctgctctgttttcatctttctctgcattcacacaggtgctccgttcacagctaacagaatgttatcttacctcttcctggcaaagcttacaccttcatcttctgtctgaagggacccttctaagctctaggctcattagcaaagcaaagataatcgatgcatgcagacctcattgaataatcagtcatctctcagttcagtttaccacctctgttcatttccctagatcatccttaatacaccactccttcgagttttcttcttccacataagatattttttcacaatctcattattatgcacatcataattttgcatcatgcatgcatgaaaacaataacaaacctttttcatttaaaaaaagaccaatgtcattcattcacagccaagtttctgttctagacatatttctagtgttcttgtgggtctagctaagggagggtccagggttaatgaaatatccctgatttttcgttaacaaaacctttgtggactcaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 435909 - DNA, 1712 bp, Homo sapiens
aaacgggggctagggagcgagggccccgtgcgcgtgttaaaaactctggcaccgaaggtgagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgct

SEQ ID NO: 435910 - DNA, 1035 bp, Homo sapiens
ccttcacctcactttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgatctagcgtccaaccagtgggtgtggtcttgtcgcagagccgtgcatagactgctgg

SEQ ID NO: 435911 - DNA, 1940 bp, Homo sapiens
cccttgcacacccacagggtagacggatcgagtttcagcttaaaccgaggggtgtgggggaagggtgttgggttcagctagtccacgtgggtgctgtcctccacttggtgctgaaatctgggcggccacatccccggggcgggagggggctacatccccggctttagacgcgcgagtctcaggtcccgctaattacctggcgggtgctgcccacccctgccctcgcgcacctagcgcggtggcaggcgggaaggcggggcctgggggagccccacccctggagactgcggctggggcctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgctgcagctgtctgtgttacttctaatggtgggg

SEQ ID NO: 435912 - DNA, 744 bp, Homo sapiens
tatgaagaatagggcgaaggggcctgcggcgtattcgatgttgaagcctgagactagttcggactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 435913 - DNA, 1369 bp, Homo sapiens
cccttgcacacccacagggtagacggatcgagtttcagcttaaaccgaggggtgtgggggaagggtgttgggttcagctagtccacgtgggtgctgtcctccacttggtgctgaaatctgggcggccacatccccggggcgggagggggctacatccccggctttagacgcgcgagtctcaggtcccgctaattacctggcgggtgctgcccacccctgccctcgcgcacctagcgcggtggcaggcgggaaggcggggcctgggggagccccacccctggagactgcggctggggcctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgagcctcctcattcacccaggcgcacttctctattagtgccgactgtcatctcag

SEQ ID NO: 435914 - DNA, 2052 bp, Homo sapiens
aaacgggggctagggagcgagggccccgtgcgcgtgttaaaaactctggcaccgaaggtgagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggcttttcccctcctccatccgtagtgttgtgtcatgggaggaaagaactgagcagatctgaagaaactgagctggccagccagaggcaactagaactattaggaaagcatagactctgaaagtccctaaagagattaccaaggtttaccctctttctaattccccctcctcccgcggagcaaagccagacatggccaactggacagctcccaggtaactgcactaggtctaggcgtctgtgccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgct

SEQ ID NO: 435915 - DNA, 2075 bp, Homo sapiens
aaacgggggctagggagcgagggccccgtgcgcgtgttaaaaactctggcaccgaaggtgagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggcttttcccctcctccatccgtagtgttgtgtcatgggaggaaagaactgagcagatctgaagaaactgagctggccagccagaggcaactagaactattaggaaagcatagactctgaaagtccctaaagagattaccaaggtttaccctctttctaattccccctcctcccgcggagcaaagccagacatggccaactggacagctcccaggtaactgcactaggtctaggcgtctgtgccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggcatacatatctggaaattggcacggcaacgcgggttactgctaatccgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgct

SEQ ID NO: 435916 - DNA, 428 bp, Homo sapiens
tccactagtgtaggcccactagtgtaggctcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 435917 - DNA, 1067 bp, Homo sapiens
ctgtctgtgttacttctaatggtggggtgaggagggagcagccttcaggaaatgaaaagaggcagtgggattatttatgatggaaagagactccagatatggcaacccaggaacactgattctcaggaatccaaccaaagggcctaaggtctccagcacttcccctgagactggagtctcctttggagcctggagaagagcatcagaacttggacaatgcacttctgactcagaataccagacaccttgatcaagacaccaagccccctgaccttccctccctcctgctcccaactcagcaccctatgatgctcactacctttgttcactttcttaagcaatgagaccagataggagcaggcagaaagactgagaggtggactccaagagatttctcggactccaagaggtatggacaagtaacgtgaagcatattatcaaggaacagaacccagaggcaaaacgggccaggccttgtagacaggaacctgtttggcagcaagaaagcaagaagtagagggttggaggacagtcagagagcattgtctgaggagcaagaattgcccagggcagcaaatctgagtctggtagggtggactcttaccaggttttgtagtgccctctctgccagggctgcctggtggaggggggtcagtgccagcagctgctctggagctctttgcaccagctccaccaccaacataatggattcattggatagtctgtccatcaactggattctattatagcaatttgacaacaatatcattcaagtggagctgggccaagtcgagaagggaccacagaaccccacagtccccagctaagatgtgaccccagaccaaatttagtgaagctggacaggaactgacagtaaacagctccagggccaattcccaccatcaagcttgagtgggggagaaaaagggagcaacatatttctagtcttcctaaaaaaaaaaaataacgaacaatcctacctgatctaatggactcaaaagctccaaatattaagtaccattaacatttccccattttatagattaaaaaactgaggttcacagaga

SEQ ID NO: 435918 - DNA, 1487 bp, Homo sapiens
ctgtctgtgttacttctaatggtggggtgaggagggagcagccttcaggaaatgaaaagaggcagtgggattatttatgatggaaagagactccagatatggcaacccaggaacactgattctcaggaatccaaccaaagggcctaaggtctccagcacttcccctgagactggagtctcctttggagcctggagaagagcatcagaacttggacaatgcacttctgactcagaataccagacaccttgatcaagacaccaagccccctgaccttccctccctcctgctcccaactcagcaccctatgatgctcactacctttgttcactttcttaagcaatgagaccagataggagcaggcagaaagactgagaggtggactccaagagatttctcggactccaagaggtatggacaagtaacgtgaagcatattatcaaggaacagaacccagaggcaaaacgggccaggccttgtagacaggaacctgtttggcagcaagaaagcaagaagtagagggttggaggacagtcagagagcattgtctgaggagcaagaattgcccagggcagcaaatctgagtctggtagggtggactcttaccaggttttgtagtgccctctctgccagggctgcctggtggaggggggtcagtgccagcagctgctctggagctctttgcaccagctccaccaccaacataatggattcattggatagtctgtccatcaactggattctattatagcaatttgacaacaatatcattcaagtggagctgggccaagtcgagaagggaccacagaaccccacagtccccagctaagatgtgaccccagaccaaatttagtgaagctggacaggaactgacagtaaacagctccagggccaattcccaccatcaagcttgagtgggggagaaaaagggagcaacatatttctagtcttcctaaaaaaaaaaaataacgaacaatcctacctgatctaatggactcaaaagctccaaatattaagtaccattaacatttccccattttatagattaaaaaactgaggttcacagagatcaaatgttgaggtctctcactcccaattcccgtttttttccacaggaccacccttcctctgcttgtgaagaggtcccttcttgtttgtacgtgctatacaatttacaaagttctttcaggtgttatctcatttgatcctacaacaagacctggcctcactccatcactcaggctggagcacagtggtgctgcgatctcagttcactgcaacccgcacctcccaggttcaagcaattctcgtgcctcagcctcccgaatagctggaattacacgcacgtgccaccacgcccagctaacttttgtatttttagtagagatggtgttttgccatgttggccagtctggtcttgaacacctgacctccgtgatccacccaccttggcctccccaaatgctgggattataggcatgagccactg

SEQ ID NO: 435919 - DNA, 335 bp, Homo sapiens
aaaaaaagttcaggagacagagctctgagcaggttcagggctctttcaggtaggactagtctctgcctctattgaccctgctcccaatccctatctcctctctaggatagccgcttcccaaagatcctggagaacctaagactccaaaagcgtggtactggaggagtggacactgctgccacaggcggtgtctttgatatttctaatttggaccgactaggcaaatcagaggtgagatcctaagggattaggatgaggagaggtataggtctgtgggggctgaaatatggcagtgagtgagcctccgggatgtaacataatctgaaatgaaattc

SEQ ID NO: 435920 - DNA, 2607 bp, Homo sapiens
cgcggagggcgggccctgctctagcgggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 435921 - DNA, 2692 bp, Homo sapiens
cgcggagggcgggccctgctctagcgggccgcgtagcggacatggcgggctcccggctcccgcggcagctcttcctccagggcgtggcggccgtcttcatgtttgctttcgcttccctctacacgcaaatcccaggctgggggatctgcaggccctgactcagaggtagtctagtctgcaagggctgtccagggcctggccatgacatgccctcccacaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 435922 - DNA, 2750 bp, Homo sapiens
cgcggagggcgggccctgctctagcgggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccagtgagtgccgacctgggggggccagagggcaggggcggaccagtcctcacacccccctcctccaccagctttcaccttccaccagttttctcagtggctgaagacactgacgctgcccactgtgtggctgggtgtggcctccctggtctgggagctgctgagtgccctgtggaggtacatggcccaggaagcagggagggggcacaggtgtgcagggccggcctgacgaccttgggtccttgcccacaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 435923 - DNA, 3160 bp, Homo sapiens
  misc_feature (2622)..(2623): n is a, c, g, or t
  misc_feature (2958)..(2958): n is a, c, g, or t
cgcggagggcgggccctgctctagcgggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggcaaaaaaaaaaaaaannaaaaaaaaaaaaaagggggggcccaaaaaatttccccggaaggggccccaaggtgttaccgcgacccccaggcttttcgtggtccccaagggtggcccctaaatggggaactcgaatatataaagcaaggaaatgggaccgtcgtttataacaaacgactcgaggaactggggaaaaacacgtgcctaacacctgggagacatctgtggggaaagagaaaccttacactgtccggggggcgggggtgacaatagtctggggacaaacttatcccctctagagaaaggaaattttaaaagaggctctctagaggggggagaacatgtattagacanatcttttaaacagggtagctataaacaggggtggtaaacaacattaggaactgcgaaaatattagactagagcattgattgagaaaaacgtattggcgcctaccacgagagaaagatattaggagtttagtggaacagaatattctaattcacacggggggaagtctctttttgttaataaaatcgcggtaagacaatagtt

SEQ ID NO: 435924 - DNA, 2497 bp, Homo sapiens
tgcagactctgacctagggatggaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 435925 - DNA, 2522 bp, Homo sapiens
cgcggagggcgggccctgctctagcgggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 435926 - DNA, 2353 bp, Homo sapiens
cgcggagggcgggccctgctctagcgggccgcgtagcggacatggcgggctcccggctcccgcggcagctcttcctccagggcgtggcggccgtcttcatgtttgctttcgcttccctctacacgcaaatcccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 435927 - DNA, 1197 bp, Homo sapiens
  misc_feature (20)..(20): n is a, c, g, or t
  misc_feature (27)..(27): n is a, c, g, or t
cggatatttgggatcaccanattaaancaaacccgctgggcattttaaaagcagctgtcggtcgattccggatgaggagatgagtcatgtcagctggactgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 435928 - DNA, 1158 bp, Homo sapiens
ggcccagctgacctcggcctgcctggcaggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 435929 - DNA, 935 bp, Homo sapiens
cgcggagggcgggccctgctctagcgggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccacaacgaattccggcacgacgacgacgaa

SEQ ID NO: 435930 - DNA, 579 bp, Homo sapiens
gcctggggctgtgggaggctgggtagggggtgggggagggctctgcccttcctgggaggactttccgagggaagcagctgtgtggggaggggctcttggtgctatttgctctccccatagggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgccggcggcttggggtctgtaggacccagtttgaaaccccagtgttatgtgatgctaaaatgctgactttccttccctgcctgtcagctttgctctttggaggtgcctaatggccccagttgctgacctaattgcggccggtgtactggttggtacctgaattgcgtgatgaggtgataggggggctttgatactctgggtggctggtctgctatattataagtctaggggaaatgatttctctgaaagcagtaaaaggtgtaaataatgcttcattgcaaatcatcaagactattattatattcag

SEQ ID NO: 435931 - DNA, 2682 bp, Homo sapiens
cgcggagggcgggccctgctctagcgggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtacatggcccaggaagcagggagggggcacaggtgtgcagggccggcctgacgaccttgggtccttgcccacaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 435932 - DNA, 2714 bp, Homo sapiens
cgcggagggcgggccctgctctagcgggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccaggtgcggagcgggcttggggggtgtggagtgggctggggtggagcggggtggggaggggaggggcagggcgggtactgtgggggccacgctgatgcctctcgctgcagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 435933 - DNA, 3404 bp, Homo sapiens
cgcggagggcgggccctgctctagcgggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggcaaaaaacacacaaaacaaacacaaagcaaacaacacaaacagaaacacacaaaccagaaacaaaaaacaagaacaaacaacagcacagaacacaacagaaaacaaaccacagacaacaaaagaaagacagaaacaaaagaaaaaaatagggccagcgcggagcgcaacaagaaatatacaggcggaacgggaggcacacgcacaaaaaaagacgcagcacctagcaaataaacaaacagagaaaggagcgacccgcagaaagcgagcgaggaccactaaagaccacaacacgagagagcagagacgcacgacgaagaaaagagacagagtcagagcgagaggacgagaaagacgaaagacgagaacagaaggcgacgagcgacggcggtagcagagggcgcacaacacacaaaactagaacgggcgaggcgcgaggaaagcaaagaaaaggggggcgcgacccgacgcacggtccacacgcacgagaaagcgcaatgccgaccgagcagagggggcagacgccacagacacagaccgagaagaggagcgagcgcgcaggctgggcggcgagcaccacccacgccgagacatagcgacacgggggacgagaagacgaagaagaagaggggagagcgcaacaggtagaagccagacagacccagaccagcaaaagagcacaacaccacccagcgcagcgagcagcgagccacagagacagcaacggcgccacacaccgcagagagagcagcaagaacaacagaccaccagcaggaccgagcacagcagagcacacagca

SEQ ID NO: 435934 - DNA, 2683 bp, Homo sapiens
  misc_feature (2624)..(2624): n is a, c, g, or t
cgcggagggcgggccctgctctagcgggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggcaaaaaaaaaatattttnaaattaaataataaaattaaacttcaggggggggcccggaccccaatcgcccttttggg

SEQ ID NO: 435935 - DNA, 1748 bp, Homo sapiens
cctccttgcaggtaggatgccctcgggcgcatacaggcctgggatttgcgtgtcgagggaagcgaaacaagacatgaagacggccgccacgccctggagaagagtgcgcggaccgggagcccgcctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 435936 - DNA, 1636 bp, Homo sapiens
cgcggagggcgggccctgctctagcgggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgttggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttggaaacccctggggccaaaacaacggtatcagggccgggggataaaaaaaccctgggtctttgcg

SEQ ID NO: 435937 - DNA, 239 bp, Homo sapiens
gggggctcggccagccctgactcctgccctcgcctgcagccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgggtgagggccgcagctgt

SEQ ID NO: 435938 - DNA, 3625 bp, Homo sapiens
cgcctccccgcgcctcgttcgccgccgctgtcgccgccgccgcccgagactcgcgcagagcagttatggcggatcccgcagcccccacgcccgcagctcccgctccagcccaggccccggctccagccccggaggcagtcccggccccagccgcagcccccgtcccggcgccggcgcccgcctcggactcggcctccgggccgtcctcggactccggcccagaagccggctcgcagcgcctgctgttttctcacgacctggtgtcgggccgttaccgtggctccgtgcacttcgggctggtgcgcctcatccacggcgaggactcggactcggagggcgaggaggagggccgcgggagctcggggtgctccgaggccgggggcgcgggccacgaggagggccgggccagccccctgcgccgcggctacgtgcgcgtccagtggtacccggagggcgtcaagcagcatgtgaaggagaccaagctgaaactagaggaccgttctgtggtgccccgagatgtggtccggcacatgcgatccaccgacagtcagtgtggcacggtgatcgacgtcaacatcgactgtgccgtcaagctcatcggcaccaactgcatcatctatcccgtcaacagcaaggacctgcagcacatctggcccttcatgtatggggactacattgcctatgactgctggctggggaaggtctacgacttgaagaaccagatcatcctgaagctatccaacggcgccaggtgctccatgaacacggaagatggcgccaagctctacgacgtctgcccgcacgtcagcgactcgggtctcttcttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgcaggttgtagagttgaaagttacatggattaccaagagtttctgtccagggggcacggacagcgtcagccccccaccctctgtcatcacccaggaaaacctaggcagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatggctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgagtccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctgtgagtcagcccttgcctggtcttcgccttcccccgccttctcggggctcctgtttgtgtcaccagatctgggtgcagggtggttagtcccctcgccagaccccagctactgccccagggcaaaccatttccctgtgtggtcacagtgctgaggccagcagcggcgagtgggaagtctgtgggtgtgctcacctgtccagccaggttggcagatggagctccagggcctctccatgagggactgactattctcttcccccctctagcaaatcattcttttaagaaaattgagttccagcctccagaagccaagaagttcttcagcacagtgcggaaggagatggcgctgctggctacctcactgcctgagggcatcatggtcaagacttttgaagatagaatggcaagtaggcttggcatgggcaggtgcagatgtgctgtgtgggcacccagccaagaggccaccaaccttgggtccccaaacctccggggctgactggcacctgcgaggacactcacccacccaccttttacaggggcggtcacaggctcagtcaggtgagggctgactcagccgtgtgtccaggccagatggttctttctttcctccctcctttaaaaaattactttctcggccgggcgcagtggctcacacccgtaatcccagcactttgggaggccgaggtgggtggatcacgaggtcaggagatcgagaccatcctggctaacacagtgaaaccccgtctccact

SEQ ID NO: 435939 - DNA, 5355 bp, Homo sapiens
cgcctccccgcgcctcgttcgccgccgctgtcgccgccgccgcccgagactcgcgcagagcagttatggcggatcccgcagcccccacgcccgcagctcccgctccagcccaggccccggctccagccccggaggcagtcccggccccagccgcagcccccgtcccggcgccggcgcccgcctcggactcggcctccgggccgtcctcggactccggcccagaagccggctcgcagcgcctgctgttttctcacgacctggtgtcgggccgttaccgtggctccgtgcacttcgggctggtgcgcctcatccacggcgaggactcggactcggagggcgaggaggagggccgcgggagctcggggtgctccgaggccgggggcgcgggccacgaggagggccgggccagccccctgcgccgcggctacgtgcgcgtccagtggtacccggagggcgtcaagcagcatgtgaaggagaccaagctgaaactagaggaccgttctgtggtgccccgagatgtggtccggcacatgcgatccaccgacagtcagtgtggcacggtgatcgacgtcaacatcgactgtgccgtcaagctcatcggcaccaactgcatcatctatcccgtcaacagcaaggacctgcagcacatctggcccttcatgtatggggactacattgcctatgactgctggctggggaaggtctacgacttgaagaaccagatcatcctgaagctatccaacggcgccaggtgctccatgaacacggaagatggcgccaagctctacgacgtctgcccgcacgtcagcgactcgggtctcttcttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgcaggttgtagagttgaaagttacatggattaccaagagtttctgtccagggggcacggacagcgtcagccccccaccctctgtcatcacccaggaaaacctaggcagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatggctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgagtccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggaaggagatggcgctgctggctacctcactgcctgagggcatcatggtcaagacttttgaagatagaatggacctcttctcagctctcatcaagggccccactcgaaccccctacgaggatggcctctacttgtttgacatccagctccccaacatctacccagccgtgcccccccacttctgctacctctcccaatgcagtggccgcctgaaccccaacctgtatgacaatgggaaggtgtgtgtcagcctcctgggcacctggattggaaaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagagcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgtaatatttaaggttggaaaaaaaactcaaaagcaaagatattaactcttattagaaaaaaagacaaaaaaaaagccaaagcatgatgcgtcttgtcagccttaagtgggctccacacctgtgctgtgctgtgaccgcccagccagcagagctgcgggaggatggagccggaccacacaccgtggcatttggaaccgagtcggtatcttgtttgagaaacacccggagtgactggtggggctgtgcttcccagtgcattgtacatgtggagatgtgaatgcctactgcttacgatatctgtataaagtgctgtgtgattaaacttttttttacttgca

SEQ ID NO: 435940 - DNA, 5440 bp, Homo sapiens
cgcctccccgcgcctcgttcgccgccgctgtcgccgccgccgcccgagactcgcgcagagcagttatggcggatcccgcagcccccacgcccgcagctcccgctccagcccaggccccggctccagccccggaggcagtcccggccccagccgcagcccccgtcccggcgccggcgcccgcctcggactcggcctccgggccgtcctcggactccggcccagaagccggctcgcagcgcctgctgttttctcacgacctggtgtcgggccgttaccgtggctccgtgcacttcgggctggtgcgcctcatccacggcgaggactcggactcggagggcgaggaggagggccgcgggagctcggggtgctccgaggccgggggcgcgggccacgaggagggccgggccagccccctgcgccgcggctacgtgcgcgtccagtggtacccggagggcgtcaagcagcatgtgaaggagaccaagctgaaactagaggaccgttctgtggtgccccgagatgtggtccggcacatgcgatccaccgacagtcagtgtggcacggtgatcgacgtcaacatcgactgtgccgtcaagctcatcggcaccaactgcatcatctatcccgtcaacagcaaggacctgcagcacatctggcccttcatgtatggggactacattgcctatgactgctggctggggaaggtctacgacttgaagaaccagatcatcctgaagctatccaacggcgccaggtgctccatgaacacggaagatggcgccaagctctacgacgtctgcccgcacgtcagcgactcgggtctcttcttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgcaggttgtagagttgaaagttacatggattaccaagagtttctgtccagggggcacggacagcgtcagccccccaccctctgtcatcacccaggaaaacctaggcagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatggctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgagtccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggaaggagatggcgctgctggctacctcactgcctgagggcatcatggtcaagacttttgaagatagaatggacctcttctcagctctcatcaagggccccactcgaaccccctacgaggatggcctctacttgtttgacatccagctccccaacatctacccagccgtgcccccccacttctgctacctctcccaatgcagtggccgcctgaaccccaacctgtatgacaatgggaaggtgtgtgtcagcctcctgggcacctggattggaaaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagagcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgtaatatttaaggttggaaaaaaaactcaaaagcaaagatattaactcttattagaaaaaaagacaaaaaaaaagccaaagcatgatgcgtcttgtcagccttaagtgggctccacacctgtgctgtgctgtgaccgcccagccagcagagctgcgggaggatggagccggaccacacaccgtggcatttggaaccgagtcggtatcttgtttgagaaacacccggagtgactggtggggctgtgcttcccagtgcattgtacatgtggagatgtgaatgcctactgcttacgatatctgtataaagtgctgtgtgattaaacttttttttacttgcattttttttttttttttttttttgttggctcattagcaagacaaggtgacaccattaaacctccctctgccattcatctgggctcc

SEQ ID NO: 435941 - DNA, 3602 bp, Homo sapiens
aatacgtttgaagatcctcttcagtctatctgaactgatccaaacgcttgagtatctggccgtcgtattatcagatcggtcgagtactggaatactccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggaaggagatggcgctgctggctacctcactgcctgagggcatcatggtcaagacttttgaagatagaatggacctcttctcagctctcatcaagggccccactcgaaccccctacgaggatggcctctacttgtttgacatccagctccccaacatctacccagccgtgcccccccacttctgctacctctcccaatgcagtggccgcctgaaccccaacctgtatgacaatgggaaggtgtgtgtcagcctcctgggcacctggattggaaaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagagcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgtaatatttaaggttggaaaaaaaactcaaaagcaaagatattaactcttattagaaaaaaagacaaaaaaaaagccaaagcatgatgcgtcttgtcagccttaagtgggctccacacctgtgctgtgctgtgaccgcccagccagcagagctgcgggaggatggagccggaccacacaccgtggcatttggaaccgagtcggtatcttgtttgagaaacacccggagtgactggtggggctgtgcttcccagtgcattgtacatgtggagatgtgaatgcctactgcttacgatatctgtataaagtgctgtgtgattaaacttttttttacttgca

SEQ ID NO: 435942 - DNA, 2971 bp, Homo sapiens
caatctcaggctctatgttgtacaagtgctggggcaggatgatggtctttgagttgtcagcccacaccacctccaccttgctgctgacgtccagacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggaaggagatggcgctgctggctacctcactgcctgagggcatcatggtcaagacttttgaagatagaatggacctcttctcagctctcatcaagggccccactcgaaccccctacgaggatggcctctacttgtttgacatccagctccccaacatctacccagccgtgcccccccacttctgctacctctcccaatgcagtggccgcctgaaccccaacctgtatgacaatgggaaggtgtgtgtcagcctcctgggcacctggattggaaaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagagcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgtaatatttaaggttggaaaaaaaactcaaaagcaaagatattaactcttattagaaaaaaagacaaaaaaaaagccaaagcatgatgcgtcttgtcagccttaagtgggctccacacctgtgctgtgctgtgaccgcccagccagcagagctgcgggaggatggagccggaccacacaccgtggcatttggaaccgagtcggtatcttgtttgagaaacacccggagtgactggtggggctgtgcttcccagtgcattgtacatgtggagatgtgaatgcctactgcttacgatatctgtataaagtgctgtgtgattaaacttttttttacttgca

SEQ ID NO: 435943 - DNA, 5621 bp, Homo sapiens
cgcctccccgcgcctcgttcgccgccgctgtcgccgccgccgcccgagactcgcgcagagcagttatggcggatcccgcagcccccacgcccgcagctcccgctccagcccaggccccggctccagccccggaggcagtcccggccccagccgcagcccccgtcccggcgccggcgcccgcctcggactcggcctccgggccgtcctcggactccggcccagaagccggctcgcagcgcctgctgttttctcacgacctggtgtcgggccgttaccgtggctccgtgcacttcgggctggtgcgcctcatccacggcgaggactcggactcggagggcgaggaggagggccgcgggagctcggggtgctccgaggccgggggcgcgggccacgaggagggccgggccagccccctgcgccgcggctacgtgcgcgtccagtggtacccggagggcgtcaagcagcatgtgaaggagaccaagctgaaactagaggaccgttctgtggtgccccgagatgtggtccggcacatgcgatccaccgacagtcagtgtggcacggtgatcgacgtcaacatcgactgtgccgtcaagctcatcggcaccaactgcatcatctatcccgtcaacagcaaggacctgcagcacatctggcccttcatgtatggggactacattgcctatgactgctggctggggaaggtctacgacttgaagaaccagatcatcctgaagctatccaacggcgccaggtgctccatgaacacggaagatggcgccaagctctacgacgtctgcccgcacgtcagcgactcgggtctcttcttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgcaggttgtagagttgaaagttacatggattaccaagagtttctgtccagggggcacggacagcgtcagccccccaccctctgtcatcacccaggaaaacctaggcagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatggctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgagtccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctgtgagtcagcccttgcctggtcttcgccttcccccgccttctcggggctcctgtttgtgtcaccagatctgggtgcagggtggttagtcccctcgccagaccccagctactgccccagggcaaaccatttccctgtgtggtcacagtgctgaggccagcagcggcgagtgggaagtctgtgggtgtgctcacctgtccagccaggttggcagatggagctccagggcctctccatgagggactgactattctcttcccccctctagcaaatcattcttttaagaaaattgagttccagcctccagaagccaagaagttcttcagcacagtgcggaaggagatggcgctgctggctacctcactgcctgagggcatcatggtcaagacttttgaagatagaatggacctcttctcagctctcatcaagggccccactcgaaccccctacgaggatggcctctacttgtttgacatccagctccccaacatctacccagccgtgcccccccacttctgctacctctcccaatgcagtggccgcctgaaccccaacctgtatgacaatgggaaggtgtgtgtcagcctcctgggcacctggattggaaaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagagcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgtaatatttaaggttggaaaaaaaactcaaaagcaaagatattaactcttattagaaaaaaagacaaaaaaaaagccaaagcatgatgcgtcttgtcagccttaagtgggctccacacctgtgctgtgctgtgaccgcccagccagcagagctgcgggaggatggagccggaccacacaccgtggcatttggaaccgagtcggtatcttgtttgagaaacacccggagtgactggtggggctgtgcttcccagtgcattgtacatgtggagatgtgaatgcctactgcttacgatatctgtataaagtgctgtgtgattaaacttttttttacttgca

SEQ ID NO: 435944 - DNA, 5060 bp, Homo sapiens
cgcctccccgcgcctcgttcgccgccgctgtcgccgccgccgcccgagactcgcgcagagcagttatggcggatcccgcagcccccacgcccgcagctcccgctccagcccaggccccggctccagccccggaggcagtcccggccccagccgcagcccccgtcccggcgccggcgcccgcctcggactcggcctccgggccgtcctcggactccggcccagaagccggctcgcagcgcctgctgttttctcacgacctggtgtcgggccgttaccgtggctccgtgcacttcgggctggtgcgcctcatccacggcgaggactcggactcggagggcgaggaggagggccgcgggagctcggggtgctccgaggccgggggcgcgggccacgaggagggccgggccagccccctgcgccgcggctacgtgcgcgtccagtggtacccggagggcgtcaagcagcatgtgaaggagaccaagctgaaactagaggaccgttctgtggtgccccgagatgtggtccggcacatgcgatccaccgacagtcagtgtggcacggtgatcgacgtcaacatcgactgtgccgtcaagctcatcggcaccaactgcatcatctatcccgtcaacagcaaggacctgcagcacatctggcccttcatgtatggggactacattgcctatgactgctggctggggaaggtctacgacttgaagaaccagatcatcctgaagctatccaacggcgccaggtgctccatgaacacggaagatggcgccaagctctacgacgtctgcccgcacgtcagcgactcgggtctcttcttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgcaggttgtagagttgaaagttacatggattaccaagagtttctgtccagggggcacggacagcgtcagccccccaccctctgtcatcacccaggaaaacctaggcagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatggctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgagtccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggaaggagatggcgctgctggctacctcactgcctgagggcatcatggtcaagacttttgaagatagaatggacctcttctcagctctcatcaagggccccactcgaaccccctacgaggatggcctctacttgtttgacatccagctccccaacatctacccagccgtgcccccccacttctgctacctctcccaatgcagtggccgcctgaaccccaacctgtatgacaatgggaaggtgtgtgtcagcctcctgggcacctggattggaaaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagagcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgtaatatttaaggttggaaaaaaaactcaaaagcaaagatattaactcttattagaaaaaaagacaaaaaaaaagccaaagcatgatgcgtcttgtcagccttaagtgggctccacacctgtgctgtgctgtgaccgcccagccagcagagctgcgggaggatggagccggaccacacaccgtggcatttggaaccgagtcggtatcttgtttgagaaacacccggagtgactggtggggctgtgcttcccagtgcattgtacatgtggagatgtgaatgcctactgcttacgatatctgtataaagtgctgtgtgattaaacttttttttacttgca

SEQ ID NO: 435945 - DNA, 4196 bp, Homo sapiens
cgcctccccgcgcctcgttcgccgccgctgtcgccgccgccgcccgagactcgcgcagagcagttatggcggatcccgcagcccccacgcccgcagctcccgctccagcccaggccccggctccagccccggaggcagtcccggccccagccgcagcccccgtcccggcgccggcgcccgcctcggactcggcctccgggccgtcctcggactccggcccagaagccggctcgcagcgcctgctgttttctcacgacctggtgtcgggccgttaccgtggctccgtgcacttcgggctggtgcgcctcatccacggcgaggactcggactcggagggcgaggaggagggccgcgggagctcggggtgctccgaggccgggggcgcgggccacgaggagggccgggccagccccctgcgccgcggctacgtgcgcgtccagtggtacccggagggcgtcaagcagcatgtgaaggagaccaagctgaaactagaggaccgttctgtggtgccccgagatgtggtccggcacatgcgatccaccgacagtcagtgtggcacggtgatcgacgtcaacatcgactgtgccgtcaagctcatcggcaccaactgcatcatctatcccgtcaacagcaaggacctgcagcacatctggcccttcatgtatggggactacattgcctatgactgctggctggggaaggtctacgacttgaagaaccagatcatcctgaagctatccaacggcgccaggtgctccatgaacacggaagatggcgccaagctctacgacgtctgcccgcacgtcagcgactcgggtctcttcttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgcaggttgtagagttgaaagttacatggattaccaagagtttctgtccagggggcacggacagcgtcagccccccaccctctgtcatcacccaggaaaacctaggcagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatggctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgagtccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggaaggagatggcgctgctggctacctcactgcctgagggcatcatggtcaagacttttgaagatagaatggacctcttctcagctctcatcaagggccccactcgaaccccctacgaggatggcctctacttgtttgacatccagctccccaacatctacccagccgtgcccccccacttctgctacctctcccaatgcagtggccgcctgaaccccaacctgtatgacaatgggaaggtgtgtgtcagcctcctgggcacctggattggaaaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagagcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaagctcgcttcaaaaaaaaaccggcgcggccg

SEQ ID NO: 435946 - DNA, 2243 bp, Homo sapiens
tgccctgtgtgtgttcaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagagcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgtaatatttaaggttggaaaaaaaactcaaaagcaaagatattaactcttattagaaaaaaagacaaaaaaaaagccaaagcatgatgcgtcttgtcagccttaagtgggctccacacctgtgctgtgctgtgaccgcccagccagcagagctgcgggaggatggagccggaccacacaccgtggcatttggaaccgagtcggtatcttgtttgagaaacacccggagtgactggtggggctgtgcttcccagtgcattgtacatgtggagatgtgaatgcctactgcttacgatatctgtataaagtgctgtgtgattaaacttttttttacttgcattttttttttttttttttttttgttggctcattagcaagacaaggtgacaccattaaacctccctctgccattcatctgggctcc

SEQ ID NO: 435947 - DNA, 747 bp, Homo sapiens
ggaagagccactggtggataggggcctggggaacagaattgatggtgccctgtgtgtgttcaggggacagagaggtggacaagcaagtccagccttctccaggtgctcatctccatccaaggtacagttgggctgaagcgggggtgcggacaagggagggccggtggaggaaagtgactctgatagtccccctggcaggtggagggtaggcctgcattgtgggcctctctcacccactgagggaaggtgtcccgcccacacaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagagcctggcctcagctagcagggaccacacagaccagacttcggagaccgcaccagacgcatcggtgccacccag

SEQ ID NO: 435948 - DNA, 3302 bp, Homo sapiens
ggctcgggctccggctcgggctcccgcggcgtgggctgggcagcagccaggcggcggctccgcggcgccgggcaggggccgtccgcgggtccgcgccctcgggcggcggcgtctcctgggtcccggcagccgtccgcgcgcccgggcgcaggtttggttttcctaaacaaatcctttcacagggaccgacggcacttgataatgtgacaaaaaccagcctcttccaccccactgcagtgacttttgccggaaagtggagcagtgggcacggccaaccttgtcgttcatcaatgccgcccctggcagtatctgaggatcggtggcagccatgcctccccctgccccagccgctccttcccccccacgctaatctgcatggtgtgggcgcccttgggacccccgaggactgattgtctgaccttgcttcacacgcccagtaaggactcccccaagatgtcgctcgagtggctggtggcctggagctggtcgctggatggcctgagggactgcatcgccaccggcatccagtccgtgcgggactgcgacaccaccgctgtcatcactgtggcctgcctcctggtcctcttcgtgtggtactgttatcacgtgggcagggagcagccccggccctacgtctccgtcaactccctcatgcaggctgccgatgccaacgggctgcagaatggctacgtgtactgccagtcccctgagtgcgtgcgctgcacccacaacgagggcctcaaccagaagctgtaccacaacctgcaggagtacgccaagcgctactcctggtccggcatgggccgcatccacaagggcatccgcgagcagggccggtacctcaacagccggccctccatccagaagcccgaggtcttcttcctgcccgacctgcccaccacgccctatttctcccgggacgcacagaaacatgatgtggaagtgctggaacggaacttccagaccatcctgtgtgagtttgagaccctctacaaagctttctcaaactgcagcctcccgcaaggatggaaaatgaacagcacccccagcggggagtggttcaccttttacttggtcaatcagggggtttgtgttcccaggaactgtaggaagtgcccacggacgtaccgcttgctcggaagccttcggacctgtattgggaacaatgtttttgggaacgcgtgcatctctgtgctgagccctgggactgtgataacggagcactatggacccaccaacatccgcatccgatgccatttaggtctgaaaactccaaatggctgtgagctggtggtggggggagagccccagtgctgggcagaagggcgctgccttctctttgatgactctttcctgcatgctgcgttccatgaaggttcagcagaggatggcccacgggtggttttcatggtggatttgtggcatccaaacgtcgcagcggccgaacggcaggctcttgatttcatctttgctccgggacgatgagagtatttcccatgctggagtcggcgagaagggccgaggcggggcctgggcagactgtggtccggtccagtccctaccggtgttgtttccatgctcagaaacctgcctcagcggaaagctcttatttgggattttatatcatgtcgggtccctctttcccttggttattgtaaatggaaacttttcggcttgtatttccttagattttttttttttccttccaatcatttgcttcagagactcctttctggcctaacagcgcattcctttgattggtccttgagtgaccagagacttagtgcccttgtaagtctgtcttctgttgctacttgtttttttcagtgctctgaaatagagtaactaaatggttatttgtctgaatataataatgtaaaacttcttgtggtcatcttaaaaaaaaaaaaaaaaaactaaaaactgcaaaccagagagctagagaacttggcctctgatgctggcacactggggacccttcagccacctgacggcagggggacagtctgcagcccccacacctgactggcttcagtagccaggtggaggggctgccagacacagtcagggtggcacacagtgtccaggcccagggatactgtcaccatcgctcacctcattctaaaccttgtcaggtccctgatggcaaaagcattgggccagtaggactggaggctactctttaaacatggctttcctgcaaagctgaagctggtgtcccccagcaccaagctgcggctcacacagatcagccacggaacgtgtgatccgcttacctcactgcctacagaagccctactgccaaactgggcctggaaaattcccagttttaggtgttttgagtccacagtgatgaacgttaaggccaccaggttggctgataggagctgtagggggataggaccgcgctcacccagcgacatttggggaaagcctttctctggcaaaactggaataatagatctgaccaaagtttctgttttgctttggagttctgttgcctatgtttttttttttttcatttatttgtctgtacataaatgttcaaacactagacttggagatagtggaagagttggccctgtgtctttgtcatggcacaaaggtgtgcactgcgtgacaatgacccaagccagtgtgtgctagtgaggagacagagaagacctacatgcccagaggacccgtggccgttgtgctggttttctggtctcctgtgaagaacatgtggatctcttcccgaaggaaaaggtcccaggagaccagtttgaggcactcactctagaaatagcctgtgttagctgatgtgtgaaagcgtagccggccagccacactagagatgccttttctgaataatgtattatgagcagtgtcagatttataaagccgaggagtggtttggaatatacagctggtcgcaggtgcaggtccagtgtttagatccaaatggaaaacagcagcttctaagaggtacaactgttggaagaaaacacagttgaaatgcaccaggcaggtactagcaagtgtgcaaagagcacgtctacatttgagtaaaatgtctacacagatatttgtcagtgatgagaatgcaggaaaaggcagacatttcaaacatacctgaagtctttttactcattatcttgttaaagaatcactgaggtgcatgatttctacacatcgtgactgctctgctctgcgtttacaaaaccaacagcccgcgcaggtacctagctacctgcattcatgtgacatgtctggggaacagaagataaataaaggatcttgctgaaaaccaaaatgaagtg

SEQ ID NO: 435949 - DNA, 3162 bp, Homo sapiens
ggctcgggctccggctcgggctcccgcggcgtgggctgggcagcagccaggcggcggctccgcggcgccgggcaggggccgtccgcgggtccgcgccctcgggcggcggcgtctcctgggtcccggcagccgtccgcgcgcccgggcgcaggtttggttttcctaaacaaatcctttcacagggaccgacggcacttgataatgtgacaaaaaccagcctcttccaccccactgcagtgacttttgccggaaagtggagcagtgggcacggccaaccttgtcgttcatcaatgccgcccctggcagtatctgaggatcggtggcagccatgcctccccctgccccagccgctccttcccccccacgctaatctgcatggtgtgggcgcccttgggacccccgaggactgattgtctgaccttgcttcacacgcccagtaaggactcccccaagatgtcgctcgagtggctggtggcctggagctggtcgctggatggcctgagggactgcatcgccaccggcatccagtccgtgcgggactgcgacaccaccgctgtcatcactgtggcctgcctcctggtcctcttcgtgtggtactgttatcacgtgggcagggagcagccccggccctacgtctccgtcaactccctcatgcaggctgccgatgccaacgggctgcagaatggctacgtgtactgccagtcccctgagtgcgtgcgctgcacccacaacgagggcctcaaccagaagctgtaccacaacctgcaggagtacgccaagcgctactcctggtccggcatgggccgcatccacaagggcatccgcgagcagggccggtacctcaacagccggccctccatccagaagcccgaggtcttcttcctgcccgacctgcccaccacgccctatttctcccgggacgcacagaaacatgatgtggaagtgctggaacggaacttccagaccatcctgtgtgagtttgagaccctctacaaagctttctcaaactgcagcctcccgcaaggatggaaaatgaacagcacccccagcggggagtggttcaccttttacttggtcaatcagggggtttgtgttcccaggaactgtaggaagtgcccacggacgtaccgcttgctcggaagccttcggacctgtattgggaacaatgtttttgggaacgcgtgcatctctgtgctgagccctgggactgtgataacggagcactatggacccaccaacatccgcatccgatgccatttaggtctgaaaactccaaatggctgtgagctggtggtggggggagagccccagtgctgggcagaagggcgctgccttctctttgatgactctttcctgcatgctgcgttccatgaaggttcagcagaggatggcccacgggtggttttcatggtggatttgtggcatccaaacgtcgcagcggccgaacggcaggctcttgatttcatctttgctccgggacgatgagagtatttcccatgctggagtcggcgagaagggccgaggcggggcctgggcagactgtggtccggtccagtccctaccggtgttgtttccatgctcagaaacctgcctcagcggaaagctcttatttgggattttatatcatgtcgggtccctctttcccttggttattgtaaatggaaacttttcggcttgtatttccttagattttttttttttccttccaatcatttgcttcagagactcctttctggcctaacagcgcattcctttgattggtccttgagtgaccagagacttagtgcccttgtaagtctgtcttctgttgctacttgtttttttcagtgctctgaaatagagtaactaaatggttatttgtctgaatataataatgtaaaacttcttgtggtcatcttaaaaaaaaaaaaaaaaaactaaaaactgcaaaccagagagctagagaacttggcctctgatgctggcacactggggacccttcagccacctgacggcagggggacagtctgcagcccccacacctgactggcttcagtagccaggtggaggggctgccagacacagtcagggtggcacacagtgtccaggcccagggatactgtcaccatcgctcacctcattctaaaccttgtcaggtccctgatggcaaaagcattgggccagtaggactggaggctactctttaaacatggctttcctgcaaagctgaagctggtgtcccccagcaccaagctgcggctcacacagatcagccacggaacgtgtgatccgcttacctcactgcctacagaagccctactgccaaactgggcctggaaaattcccagttttaggtgttttgagtccacagtgatgaacgttaaggccaccaggttggctgataggagctgtagggggataggaccgcgctcacccagcgacatttggggaaagcctttctctggcaaaactggaataatagatctgaccaaagtttctgttttgctttggagttctgttgcctatgtttttttttttttcatttatttgtctgtacataaatgttcaaacactagacttggagatagtggaagagttggccctgtgtctttgtcatggcacaaaggtgtgcactgcgtgacaatgacccaagccagtgtgtgctagtgaggagacagagaagacctacatgcccagaggacccgtggccgttgtgctggttttctggtctcctgtgaagaacatgtggatctcttcccgaaggaaaaggtcccaggagaccagtttgaggcactcactctagaaatagcctgtgttagctgatgtgtgaaagcgtagccggccagccacactagagatgccttttctgaataatgtattatgagcagtgtcagatttataaagccgaggagtggtttggaatatacagctggtcgcaggtgcaggtccagtgtttagatccaaatggaaaacagcagcttctaagaggtacaactgttggaagaaaacacagttgaaatgcaccagaatcactgaggtgcatgatttctacacatcgtgactgctctgctctgcgtttacaaaaccaacagcccgcgcaggtacctagctacctgcattcatgtgacatgtctggggaacagaagataaataaaggatcttgctgaaaaccaaaatgaagtg

SEQ ID NO: 435950 - DNA, 2348 bp, Homo sapiens
ggctcgggctccggctcgggctcccgcggcgtgggctgggcagcagccaggcggcggctccgcggcgccgggcaggggccgtccgcgggtccgcgccctcgggcggcggcgtctcctgggtcccggcagccgtccgcgcgcccgggcgcaggtttggttttcctaaacaaatcctttcacagggaccgacggcacttgataatgtgacaaaaaccagcctcttccaccccactgcagtgacttttgccggaaagtggagcagtgggcacggccaaccttgtcgttcatcaatgccgcccctggcagtatctgaggatcggtggcagccatgcctccccctgccccagccgctccttcccccccacgctaatctgcatggtgtgggcgcccttgggacccccgaggactgattgtctgaccttgcttcacacgcccagtaaggactcccccaagatgtcgctcgagtggctggtggcctggagctggtcgctggatggcctgagggactgcatcgccaccggcatccagtccgtgcgggactgcgacaccaccgctgtcatcactgtggcctgcctcctggtcctcttcgtgtggtactgttatcacgtgggcagggagcagccccggccctacgtctccgtcaactccctcatgcaggctgccgatgccaacgggctgcagaatggctacgtgtactgccagtcccctgagtgcgtgcgctgcacccacaacgagggcctcaaccagaagctgtaccacaacctgcaggagtacgccaagcgctactcctggtccggcatgggccgcatccacaagggcatccgcgagcagggccggtacctcaacagccggccctccatccagaagcccgaggtcttcttcctgcccgacctgcccaccacgccctatttctcccgggacgcacagaaacatgatgtggaagtgctggaacggaacttccagaccatcctgtgtgagtttgagaccctctacaaagctttctcaaactgcagcctcccgcaaggatggaaaatgaacagcacccccagcggggagtggttcaccttttacttggtcaatcagggggtttgtgttcccaggaactgtaggaagtgcccacggacgtaccgcttgctcggaagccttcggacctgtattgggaacaatgtttttgggaacgcgtgcatctctgtgctgagccctgggactgtgataacggagcactatggacccaccaacatccgcatccgatgccatttaggtctgaaaactccaaatggctgtgagctggtggtggggggagagccccagtgctgggcagaagggcgctgccttctctttgatgactctttcctgcatgctgcgttccatgaaggttcagcagaggatggcccacgggtggttttcatggtggatttgtggcatccaaacgtcgcagcggccgaacggcaggctcttgatttcatctttgctccgggacgatgagagtatttcccatgctggagtcggcgagaagggccgaggcggggcctgggcagactgtggtccggtccagtccctaccggtgttgtttccatgctcagaaacctgcctcagcggaaagctcttatttgggattttatatcatgtcgggtccctctttcccttggttattgtaaatggaaacttttcggcttgtatttccttagattttttttttttccttccaatcatttgcttcagagactcctttctggcctaacagcgcattcctttgattggtccttgagtgaccagagacttagtgcccttgtaagtctgtcttctgttgctacttgtttttttcagtgctctgaaatagagtaactaaatggttatttgtctgaatataataatgtacaaaaaaaaaaaaaaaaaaaaaacaaaaaaaaaaaaacaaaaaaaaaagggggggggcggccattaagatattcacccccggaaggggcccccagtttatagcggcataacacagattttttgttaacaaggggggcgcccaataaggggacggcctatatataacacaggggacacggggcggggttaaaaagaaggagacggggggaaacaagtgcttacggggagaacttttggagagaagaacacccatatagcggggggggggggggacaccaagtggggggcggagacagacctacctacggagatttttagagacggcgcagaggagggagaataataagacaagtttagagggggttatatagtgaggtttggtcaacaagggggaatattggatctgcgggtgttggaaaaattcttggcatcacggagggaatgattcttggagaaagatattttagcgc

SEQ ID NO: 435951 - DNA, 624 bp, Homo sapiens
cgagggacaggatggggtccctgccccgaagctgagcacgtagggtccagccctgcctggatcctgggtcctgactccagggtggtttgaacctgtcctctcacccctccttcccccccaggttcagcagaggatggcccacgggtggttttcatggtggatttgtggcatccaaacgtcgcagcggccgaacggcaggctcttgatttcatctttgctccgggacgatgagagtatttcccatgctggagtcggcgagaagggccgaggcggggcctgggcagactgtggtccggtccagtccctaccggtgttgtttccatgctcagaaacctgcctcagcggaaagctcttatttgggattttatatcatgtcgggtccctctttcccttggttattgtaaatggaaacttttcggcttgtatttccttagattttttttttttccttccaatcatttgcttcagagactcctttctggcctaacagcgcattcctttgattggtccttgagtgaccagagacttagtgcccttgtaagtctgtcttctgttgctacttgtttttttcagtgctctgaaatagagtaactaaatggttatttgtctgaatataataatgta

SEQ ID NO: 435952 - DNA, 346 bp, Homo sapiens
accctgtctacacaactattaggctcttacagggcagagaacgtgtatcctgtgtatgtgcacacacatacacatacataaaagtatcataagtacttaataaatatttgctaaacgaatagtaattgaaaatgacattcttactcaaatccttccgcatatacccccataaaagcagctgtatttaaattaatattttataatataatgaacaaatcagtggttgtttctaaaccttttgcatttcaaaagaaatacaacaaatacaaaagattatgttttataaactttatatatacagacttatattcaggatccaaaccatctttttcaaacaacttttttt

SEQ ID NO: 435953 - DNA, 379 bp, Homo sapiens
tgcctggtgtcagaaaggttgcgggccactgccgtaaagtattaatagtctgtttctagagtgtcttcttcctaactattctgtgcctcttctgtctgattactttcacctttattttattctaagtctgtctttctcaactaggttcttcttttgaaccacagatcatagaaaattatttgtgactattttcttaattccgccccctcaaagtggtacataataggatgattctatgtccatctggaggccttaggcttactttcaaggaaatcctgattattcatgagacagttgtgatatgctgaataatgggcttcccatgccctaatctccaggacttgtatataacaaaaggaacttttcagatcaagttaag

SEQ ID NO: 435954 - DNA, 859 bp, Homo sapiens
gtgtactaaaggccactagcctgtgggatatatgacgtttcgatctatgtttccccctcatcgcacagccgtgagtgaggacgagtcggtattcggcgagtgtttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggtaaccgctcgtctctgcccttctgtggcccacatgccctaggccctaagaacaagactaacactcgaatgcttctggtgaggggtggagataattgggaattggaaatgtttggcttgaaagagttcctgttcctctgaggactttctgcccccctccattagcgacaatgacgtggccttggcactgacttcctgacagtctctccatgtgcttcatgctcctctgattggactcagggtgagaagctgtatggcaaaattggctcatagcatatgtgtattgaatgaatcagcattcagtttggaataaaagcatctgtcttttactgt

SEQ ID NO: 435955 - DNA, 2172 bp, Homo sapiens
gcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagcaggggatctgctgttctccaccctttaaaaatggagcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccccttttattttgactga

SEQ ID NO: 435956 - DNA, 2449 bp, Homo sapiens
gcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggaggtacttggctccatgtggccctgaccagatggcgtacacagggctgcttgcttttcccagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaagggggaacgcctgagccgctttggactccgcacagagaccacaggcactgtcaccttccgcttgcactgtctgcagcagtccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagcaggggatctgctgttctccaccctttaaaaatggagcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccccttttattttgactga

SEQ ID NO: 435957 - DNA, 1750 bp, Homo sapiens
gcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaagaaatggagcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccccttttattttgactga

SEQ ID NO: 435958 - DNA, 1672 bp, Homo sapiens
gcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggtaaccgctcgtctctgcccttctgtggcccacatgccctaggccctaagaacaagactaacactcgaatgcttctggtgaggggtggagataattgggaattggaaatgtttggcttgaaagagttcctgttcctctgaggactttctgcccccctccattagcgacaatgacgtggccttggcactgacttcctgacagtctctccatgtgcttcatgctcctctgattggactcagggtgagaagctgtatggcaaaattggctcatagcatatgtgtattgaatgaatcagcattcagtttggaataaaagcatctgtcttttactgt

SEQ ID NO: 435959 - DNA, 788 bp, Homo sapiens
gcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccaaaatggagcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccccttttattttgactga

SEQ ID NO: 435960 - DNA, 758 bp, Homo sapiens
gcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggaggtattgttctttctagggtctcatagcttccatctttgcttcctctagcttttttgcctcactgagttctgtgtgttatgtcagagcctagtaaggggagacaagtagcctgtctaggaactgctgtgagctgctgctgctggcagccagcctggaatagaatgggcacagtctacaggtggtgaggctgctgctcccttctctgcctgctagagggcctgggggagctgccagtatctctgattatatgcttgcagagtgcatactgggagaa

SEQ ID NO: 435961 - DNA, 684 bp, Homo sapiens
gttcccatcagaataactggctctttcccccatcactgaaggcctcagtaatcagatgtggggaggattcacagtaagcatataagaccgccgcttctcaaatgaggttggaatgttccctggtttagttgggggagcccaatagcccagtattagccttgaggtaatagagtctgggtgatggaataaggtttccccaacagaactgcgcttcccaagaatgggaataagaatgggggtgaggccagcatggtgcgggggtgtctagagagagcagaaacctgaggctgtcccaatggcatgccacagggggaacgcctgagccgctttggactccgcacagagaccacaggcactgtcaccttccgcttgcactgtctgcagcagtccaggtgagtgacttggccctctgcctcagggcaccttagccctgaggggtggagacagccgtaaccatgtggctggcctccctgcagggccttcatggaatcgagctcccttcagaaaaggatgcggagtgtgttggaccgtctggaagggttcagccagcagagttccattcacaatgtgctaggtatgtcccctcccccagctggccaccccaggtcagcatgggcctgtttctctctgcagtgcagagagaaataccatatggcagccaaatagcatatctcctttccttac

SEQ ID NO: 435962 - DNA, 2389 bp, Homo sapiens
gcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaagggggaacgcctgagccgctttggactccgcacagagaccacaggcactgtcaccttccgcttgcactgtctgcagcagtccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagcaggggatctgctgttctccaccctttaaaaatggagcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccccttttattttgactga

SEQ ID NO: 435963 - DNA, 2291 bp, Homo sapiens
gcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaagggggaacgcctgagccgctttggactccgcacagagaccacaggcactgtcaccttccgcttgcactgtctgcagcagtccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagcaggggatctgctgttctccaccctttaaaaatggagcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccccttttattttgactga

SEQ ID NO: 435964 - DNA, 1748 bp, Homo sapiens
gcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatgataaccttgtcattggccacaaggagaacagattccaagggaggccttgcccaccctatgacactcctttttataggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggtaaccgctcgtctctgcccttctgtggcccacatgccctaggccctaagaacaagactaacactcgaatgcttctggtgaggggtggagataattgggaattggaaatgtttggcttgaaagagttcctgttcctctgaggactttctgcccccctccattagcgacaatgacgtggccttggcactgacttcctgacagtctctccatgtgcttcatgctcctctgattggactcagggtgagaagctgtatggcaaaattggctcatagcatatgtgtattgaatgaatcagcattcagtttggaataaaagcatctgtcttttactgt

SEQ ID NO: 435965 - DNA, 1508 bp, Homo sapiens
gcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccagcgacaatgacgtggccttggcactgacttcctgacagtctctccatgtgcttcatgctcctctgattggactcagggtgagaagctgtatggcaaaattggctcatagcatatgtgtattgaatgaatcagcattcagtttggaataaaagcatctgtcttttactgt

SEQ ID NO: 435966 - DNA, 2667 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaa

SEQ ID NO: 435967 - DNA, 722 bp, Homo sapiens
ggattacaggcggccgccaccacgcctagctaatttttgtatttttagcagagacggggtttcaccatgttggccaggctggtctcgaactcctgacctgaggtcatccgccctcgctggcctcccaaagtgctggaattacaggcgtgagccaccgagcccagccttgaggctcattttcaaaaggagaagggtaatgaactaggatttatgccccaaattcatatggaagatttaattatgtatgttaaagggtgctgttgtttgcatatttagccattggtttttggttttaacctatggtttgcatgttgatgttacttttagatgctggcaagtcaaccattggaggacaaataatgtatttgactggaatggttgacaaaaggacgcttgaaaagtatgaaagagaagctaaagagaaaaacagagaaacttggtatagtaaacttttatgacacttataaattacttttaaggagacgatgcccacttagtgcttttggagcctgttaaaatataaattgttgaagtctaaaatcgtatcacaacaaaggaaatttcccctctcctcataatacacagtagatgagttcctaatgctttaataacttacacagggaaatttggaaacaatccatatatctggtgatagacttgttgaaaatactataaaccatccatttaattgggtgattttgcaaccactgaaaacttacatt

SEQ ID NO: 435968 - DNA, 795 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgacacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaaaaaaacacataccaacaccccacaagaaaacacggttggggcgccctaggccctcgagaaaggttcaaaaaccaatctctggtggcggcccgggccccagatgtgaagtaacactggccaacgttggccgaaaggagcccgcgcactgcaaaggcgcgggctcccccaaaaaaaccgcggggacccagccgtctgacacaccagaggggccgcgccaagcggctaaaagggccaggagcgaaaacgcgcgcgg

SEQ ID NO: 435969 - DNA, 7436 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435970 - DNA, 7275 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435971 - DNA, 7001 bp, Homo sapiens
cgggagccggccttcgcggggcggcccgcggcggtggccgggcggggagcggacagcgggcagcgcgcccaaagacccggacccgagtgccgcccctccgcgcccctgccctgctctggagtccgcagttacccacttgagatgggaaccgtatggaacggagtgggggccgcggcggatccctgccacgaggcgcagaatgaggacagatggagccaggagtcatttggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435972 - DNA, 7025 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagccggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435973 - DNA, 6946 bp, Homo sapiens
cattttgcttactcatgtaatccaaaccaagataggttccactgataacagaaaccaaattaatttgcagagtttttttcccagtttttctcattattcactccagcattattgaccaaaatgtccagtcttccaaagtggtctacaacttttctaaaggtgtctctcagttgttgctggtcagccacatcgcactggatgaacagagtcttctgaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435974 - DNA, 7390 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435975 - DNA, 7382 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccacctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435976 - DNA, 6786 bp, Homo sapiens
ggattacaggcggccgccaccacgcctagctaatttttgtatttttagcagagacggggtttcaccatgttggccaggctggtctcgaactcctgacctgaggtcatccgccctcgctggcctcccaaagtgctggaattacaggcgtgagccaccgagcccagccttgaggctcattttcaaaaggagaagggtaatgaactaggatttatgccccaaattcatatggaagatttaattatgtatgttaaagggtgctgttgtttgcatatttagccattggtttttggttttaacctatggtttgcatgttgatgttacttttagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435977 - DNA, 6788 bp, Homo sapiens
gcccagccctattctttcaatttctttgttttcttttgagacggagccttgctctgtcgcccaggctggagtgcaatggcacggtcttggctcgctgcaacctcctcctcccaggttcaggcgattctcctgcctcagtctcctaagtactacaggtgggctcctccacacccagctaatttttgtattttcggtagagacggggcttcaccatgttggtcaggctggtgacgaacccctgaccttgtgatccgccgccttggcctcccaaagtgctcagtttacagatgtgagccaccgcacccggctcaattttcatttcaccaatcttgttcgtgatttaggtgttgtgtgtcatccattatatctttaatggtgaagaatatcctaaaaactctgatgttcttaggaatattgttctttttttaaaaattatttcaggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435978 - DNA, 7514 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacctggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435979 - DNA, 6196 bp, Homo sapiens
ggagtaaactgtttcctttcttggaattaggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435980 - DNA, 5469 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaaaaaaaaaaccaaacaaagaaagcaactgaactaaactgctaaagttattttcctggaccattcttggccaatttccgcctgatatgccccggtgttggcttgcacacgatttacattgtattcaagaaatgtggggcccctctggcgcctgttctttttatttggaaacgttaaataatggccccaaatttagacctcttgggcccctcccctcttgagtggaggcctccccaaccccggcgggcggttaccaccgcggggggaa

SEQ ID NO: 435981 - DNA, 3138 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctgg

SEQ ID NO: 435982 - DNA, 5634 bp, Homo sapiens
aggtcaggagttcgagaccagcctggccaacatggtgaaatcccgtctcaactaaaaatacaaaaattagctgggcgtggtggcaggcatctgtatctcagctactggggaggatgaggcaggagaattgtttggggggtacggggggagataggtttttgatacagggaaccatctctttaccagcccccccaaataagaccctcttattaagactacctaaatagaagtatcatgggtttggcagtaaagctagttaattagtaacttacattgtaaaaaatatttttgtgatttaaaataataagttttaatatcttatatagacttgctgttaactactgaaagatttttttaaaatttcatttctaggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435983 - DNA, 5317 bp, Homo sapiens
tgggcccaccttatatgggcaccgaatatgggtcgtttcaccttacgagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggaaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtatttttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctgggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtaacaacaaccttaggaaac

SEQ ID NO: 435984 - DNA, 2858 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaaaaacaaaacaacaacaaaaaacaaaaaaactgttttgggcgcgcttgggccccggaaaaaagtcttctttacacgacttgcgttgggggcggcgcggggcccagtggtttatgtgtgacactgggccaaaggggtccccgaggaaaccccgggtcaagagaactaggggcctggttttcccccctataaaa

SEQ ID NO: 435985 - DNA, 2414 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagagcttttaaactgacgtctagtagtatatccaggatacctagctttggtcatcttcatcatctcagtacagtacacattgcaacaggttcacagaaaacttcgattcacattcttattcgtatgagtgttttatgagttgaatgtattgaacagaattgaccacgtgctttagtagtaatgccaaatctagtaatgctctacgtgaagaatcttaattttgatgttttgtgagta

SEQ ID NO: 435986 - DNA, 1813 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaagaaagacatttccagtccatctgtatatttgttagtagccccgcttatatctttaaatttgaatttatcttctaaaagctcaaattcaggttgcagtgaaatataatgatgtacacggtcacagttttcatcatactaatctctcttcaagaaatcttcaaaatttgatttacttctgaaaatacgtttcaccttttctctcctgttgctattatctattaccatgtcagaacttagtctccattaaatgccaagcccaccgttaggcaccatgggtaaaaaatgaataggaaaccatctgtttcatacggtcttcagtcattttgcgcttttcacaatgtactggtagtagatcacaattttttttcctttgtagttacaatagctagaaagtaaatgttggaattttaaaatatgcaggtatactagattttgggaatgtgggggattggaagcatctagacattgtttgatttgtgacattcaaaagcaggtacgtcataactcgtttgcttctattttcttgcaaaaaaaaaaaa

SEQ ID NO: 435987 - DNA, 716 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagccggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgcttggcagtcaacccattggaggacaaataatgtattttgacttgaaatggttgacaaaaggacgcttggaaaagtttgaaaggaaaggcttaagaaaaaaaaccggggaaccttggggaacttgtcttggggccttaaaacacaaa

SEQ ID NO: 435988 - DNA, 214 bp, Homo sapiens
atggataataaagtggttgaatgggaagaatacatgagtagaatgaaaatattattagaagctgtttatagtcatgtaacttaacattttgatatttatgttgacttcctttaatggctttgttgttatgttctcagtggattaccgtttattccatatctggataatttgccgaacttcaatagatcagttgatggaccaatcaggctgccaa

SEQ ID NO: 435989 - DNA, 2702 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcggggcccccccccccccccaaaatttttttgggcaccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaa

SEQ ID NO: 435990 - DNA, 1914 bp, Homo sapiens
ggcggcgaggggtcaatccgcgccgggggtggggttggctgtgaggccgtcggaggtggttgggtgggaggagatccgctcacacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggtgcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattccagctgagctgctgaagatgtttggtatcgactagggatgccattgcacaactcttctcagggg

SEQ ID NO: 435991 - DNA, 693 bp, Homo sapiens
aatatatcaaaatttaaaaaaattttaatgagttataaatcttaatatagccatcttagccataaccacaaataaactcattttttctgttaaaatacttgacagagtccttgcaattgaatgtctttgttcaacaaaaactgtattaagtgttttaaatttaaaatctaatcttatgcaaatagctggtggtcaaaacctttttccatcaaaagaagatctttggtttgacttcataatctgggatgtttgtaggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggttgggcaacacctctcctgtctccagctcacagtgccttaaggggttgtttaggggagagaaatggaagtttcctacttgctacttttctagtttctgcctgggtcaagtattcccattaggaaccaccagttatgtgctcgttaatgaaaacattttttaaaacagactaaccttgcgtttaccccaccccaaatccttatgaaatgccaaatactttttacatgttatgtgtgtcagaaattcaagctcctctcc

SEQ ID NO: 435992 - DNA, 607 bp, Homo sapiens
  misc_feature (568)..(568): n is a, c, g, or t
gatgcgttgcctgtcgctgcactgtgtgcccccgcgcggctcccccctggttcctcggtctgctgtgaatcccctgaagtggaccgtcgacaagacctcatgcgtgactggcccccgttttaaaaggagcctcagccctgtcctggccgagcggaccggtccgctcggaccaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtccgagcggaccggtccgctcggaccaactatgagatgctcaaggaggagcacgaggtggctgtgctgggggcgccccaaaaccctgctcccccgacgtccaccgtgatccacatccgcagcgagacctccgtgnccgaccatgtcgtctggtccctgttcaacaccctcttca

SEQ ID NO: 435993 - DNA, 2629 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 435994 - DNA, 2652 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcaggaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 435995 - DNA, 2808 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttgagggtctcactctgtcacccaggctgacacgatcatggctcactacaatctctgccttcctgcctcaagggttcttccttgagcacctcagcctcccaagtagctgggaccacaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 435996 - DNA, 2684 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 435997 - DNA, 3282 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtatgctgagactcaattactctcttattagcttccccgtttggaagatcccaaacaccaaagatggaaggtgaaaataaagactgcgtgaccgggaagaaagtttgaattactaatagtggggaataataatttcagttttggttttaacattctggaattcctacaaaaaaaaaaaaaaaaaaaaaaagatagtaagtgggcaaaattggcaaatggctcaagttgtactattacatgactctcaattcataaaccagcaaatggtccaaggaatgttccagctgccataaaatatcttgctcttcatttccaaaagcaaatatttgttgagtgtcatcctaacgggcaagtcaccttccatctttcctagtgcatgcataattatggattataaggactgtgttttctttattaattccctttcctgtagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 435998 - DNA, 1873 bp, Homo sapiens
atttccccttgtgtaataatctcccttcttgtgaatttcgtttcggcaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 435999 - DNA, 1934 bp, Homo sapiens
aactgtgggttcatctcatggctgactcgaactggaaccttctgaccttcacagggggactatgttggagttcagagtaaaggaataggttggagaaatcgggtggcaggatgattaggtgacagttatacacttcagaccacagtgagtctctaactgcaagctgttgaaatggtcaacatatttacttttcttttttatttacagggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 436000 - DNA, 1960 bp, Homo sapiens
cagcgcaggtctgaggagctgagaagggaggcttacgtgaagggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcaggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 436001 - DNA, 902 bp, Homo sapiens
gctaaaggataggaagtgtgagaagaatgctttgaaagaaaccttaaaaacaaaacaactgactattcagagaataccaggtcttatgtggaatcatctagcacgtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 436002 - DNA, 2885 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggtaagagcagggcctcacagacatgggcctgagattggaggcttttttgacaccatttgggaaaacttcatccactttgctttctaagccccatcctcagctttctgctgagcttgagtttgaagaacatggccaggtattcagcgagagaaaagcagaactgggagccaccatgtatgtagacaagcagccaccatgaactgtgtgccaggattaatgtaagtagcagctggtctaaatgcttcagtccccctccagttcatagaatctctcctctctcagtaggagtatgtgtctgtggttcccagagcagaaatgtcactggcagtgcctctgcccaaatggagtttgcagacatgtctgggaaagagaaggagaaaagccccactgctttttgattacactgtagcactgacccatggagtgagcctggcaggaaggtgccaggacctgttctctccacaggacccagctccagatggccaaagagagcagaggcacatgtgaaatgcaatttagagcccactcactgcctgttgctgaacagtcaaaacatgctataccaaagcaagtataatgtaaagaaattggaaattcttagactctggaatgtttctgtattatcagatttatgctctccaaagaaaccacgagtttggcttatccatgcttaaattgattaacgtcgacagatggtgacataaaggacacccatgccatttcacctccacgctttagtggttatagcacagggacgatctgcttttttgaaatgttaaggacatatttttcagttactgctgagtgaagaaagaacatagctccccctcattccctgcgtaagaaaggagcttaaag

SEQ ID NO: 436003 - DNA, 2121 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtaggccctgcagggtaacttgatgtgccatagatttaatgacgtgtctaagtacattgggtcgtggtgtaacatgtcctgttccctgggtttccacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgggcacttgaatgacaatggctcgtgatcacagctgtgagaacagtcacttactgcacagcccttccttcctccttcccttcccttccttcagaaaatacttgaaatgtcattcttcagcttggt

SEQ ID NO: 436004 - DNA, 2398 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtatgctgagactcaattactctcttattagcttccccgtttggaagatcccaaacaccaaagatggaaggtgaaaataaagactgcgtgaccgggaagaaagtttgaattactaatagtggggaataataatttcagttttggttttaacattctggaattcctacaaaaaaaaaaaaaaaaaaaaaaagatagtaagtgggcaaaattggcaaatggctcaagttgtactattacatgactctcaattcataaaccagcaaatggtccaaggaatgttccagctgccataaaatatcttgctcttcatttccaaaagcaaatatttgttgagtgtcatcctaacgggcaagtcaccttccatctttcctagtgcatgcataattatggattataaggactgtgttttctttattaattccctttcctgtagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtaaggcagagggcacattttgttttggctgcatctcaaagccgattaaaaggatggttttgaacaaaaatgcacacacagccgttgggacaaagacacttaacctggataactagacgggcacaggccatccagattttcagaatatgctgataccttgctgtgctcatctgtcctacttcatgtggttaattaaggcacccgcagaacaggaaaccagtacactatgaatctggtgtttcctcttcctaagaaatgggaaggtaagatactgtatatgggcagccataagaaagaccatggacgttttgctcaatgggcctgg

SEQ ID NO: 436005 - DNA, 1608 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcaggtaaccttaattctaactacctactaaccatttggatgctggagggagtggataggcccagagcaggaaagtggaaaggggtaaaactaatatgtacaaaatcacttatagagtatgttttctttgccagcccttaatggtagggcttggctgtataggttctattgctattgttctactgttgttattattagttccacatgtttgtccgaagattctataatatttttgtttcccaagtagaaagcaataggttaaattttaaaagttgtttgttttttcatcttca

SEQ ID NO: 436006 - DNA, 1732 bp, Homo sapiens
aacccggaccacctttgtcagacagtgagctcctcaggtggctaaaagagtggctttgaccgggacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggagggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaaaaaaaaacaagcataatataaatatgattgaaaaaagatgattacaaaaatgatcttgaaaacaaataataacaaatagaataagaatacattgatataaagacattaagaaaaaaaaaaaaggggggggggcggaagaaaaattaacacggagagagggacctaaatatcggcacagacgccagctgtgttccaaaaaagaggccccataaaggagaatgataaaaaaaacagacgacgcacggccgataacaacacaaccgagagtggagacacaaaatcaacgccaggcagctaaagacaaagcaacccaatgtcgtgggggagaacacaaggaccaccacccacaagcaataacagccccgacaaacaacaaacgggagatgaatggtgcaaccacaaaaattgactgagaaaaacggacgataataaaaaaac

SEQ ID NO: 436007 - DNA, 1098 bp, Homo sapiens
cagcgcaggtctgaggagctgagaagggaggcttacgtgaagggtaagactcgcatgggcctggccggtggacaagatgtgggaactgcatggacagttatgtggaggtgcattccatcctggctggagagtgtgtgaggggcagtgggagattggtggaaaagatataggccactggtgtggaaggctgggaagccacgcttcagatcggagaaagttgctaatcagagaagcggcgttctggaggtggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtatgtttcattttgttttcacttaactacttgattttaaaagttgattgccgcaataaaatgccatcagcattgggcaggagggagaagaaattcacagcagtgattaaggctgagtttttcaggctttctgccccggtttttaccctgtgtaatacttgcactattattaacttaatgtttctcttgaagcctgctcacttattttgaaagaaaactttctatcaataccctaaatgaaaagccagtaaaacttgtcatagattaaaagtagccataaaaatatgaaatgctagctagagcatatattattgccaacccaagtttctaagcccgcagtccactccctctgttgggaagagaggggagagtagcaagtaattgccacagattaa

SEQ ID NO: 436008 - DNA, 2693 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 436009 - DNA, 2430 bp, Homo sapiens
cggagctggaggggcagagcatcagcaagagtagcagcgagcagccgcgctggtggcggcggcgcgtcgttgcagttgcgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 436010 - DNA, 4082 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggagggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaaaaaaaaacaagcataatataaatatgattgaaaaaagatgattacaaaaatgatcttgaaaacaaataataacaaatagaataagaatacattgatataaagacattaagaaaaaaaaaaaaggggggggggcggaagaaaaattaacacggagagagggacctaaatatcggcacagacgccagctgtgttccaaaaaagaggccccataaaggagaatgataaaaaaaacagacgacgcacggccgataacaacacaaccgagagtggagacacaaaatcaacgccaggcagctaaagacaaagcaacccaatgtcgtgggggagaacacaaggaccaccacccacaagcaataacagccccgacaaacaacaaacgggagatgaatggtgcaaccacaaaaattgactgagaaaaacggacgataataaaaaaac

SEQ ID NO: 436011 - DNA, 2390 bp, Homo sapiens
cagagtgtgaccacgcggtttctatgctccaagggatttatttcagtggtaggtggagcagctctgtggagcacatggctaatgataatggattgactgaccagaagcaggagaggacctagcagaagccggaggtcaagctgccccaagactgggggacagcctgggtgaagactctggacctcatgaccatgtatattccagagggggatctaaagagccccagaaattcacaaaggaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 436012 - DNA, 2639 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaactggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 436013 - DNA, 2731 bp, Homo sapiens
ccagacacctaaattatacgtcgaagactgttaaaaagttgtttttttttttttaatggaaaatatccaagaagcagcccaggagtatctgacatggtggaatggaatcagttagaaagcgaagaaatcactaaaaaaagttacttctttttttccccaccagttataatcttcaaccttactagtttataacagtttaatgtcctatagaaggatcctccactaaagttataattttaagtatagtcatatagagagatccctaatcccctgggtaatctagatactaaaggtggggaagaacagtcatattgacattctttaatccaaaaccactgtttgaaattagtaaggatattttcagcattcccaaaaacatgttattagcacgttgagctgaaaacgtttttcttcctcagtgagtacagaaaccaaagcagtctgcgtgtatgtctatgtatagactgtatcgtacctgggctcatggagtagtctaaatttaaaacgtcctctcttctacctccaatgaaaatgtttccgtgtgtggcgtctgatcttccaccgtgtgtgtggtcgtctgctggtgtagcgctgtttaaggagcgctgtgtgctgctagtgttccacgatgtgtgtggtcgtctgctggtgtagtagcactgtttgaggagcactgtgcgccgctagtgtgggtttacacttatgagtgttgtcattacatgtgttctgctcttctctccctctcctgcccctgccctgctccatcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtatgctgagactcaattactctcttattagcttccccgtttggaagatcccaaacaccaaagatggaaggtgaaaataaagactgcgtgaccgggaagaaagtttgaattactaatagtggggaataataatttcagttttggttttaacattctggaattcctacaaaaaaaaaaaaaaaaaaaaaaagatagtaagtgggcaaaattggcaaatggctcaagttgtactattacatgactctcaattcataaaccagcaaatggtccaaggaatgttccagctgccataaaatatcttgctcttcatttccaaaagcaaatatttgttgagtgtcatcctaacgggcaagtcaccttccatctttcctagtgcatgcataattatggattataaggactgtgttttctttattaattccctttcctgtagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 436014 - DNA, 1464 bp, Homo sapiens
aatatatcaaaatttaaaaaaattttaatgagttataaatcttaatatagccatcttagccataaccacaaataaactcattttttctgttaaaatacttgacagagtccttgcaattgaatgtctttgttcaacaaaaactgtattaagtgttttaaatttaaaatctaatcttatgcaaatagctggtggtcaaaacctttttccatcaaaagaagatctttggtttgacttcataatctgggatgtttgtaggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 436015 - DNA, 717 bp, Homo sapiens
taaacattaaataagccatagcgtccctataacccaacacaacaacctcaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 436016 - DNA, 1922 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggttgggcaacacctctcctgtctccagctcacagtgccttaaggggttgtttaggggagagaaatggaagtttcctacttgctacttttctagtttctgcctgggtcaagtattcccattaggaaccaccagttatgtgctcgttaatgaaaacattttttaaaacagactaaccttgcgtttaccccaccccaaatccttatgaaatgccaaatactttttacatgttatgtgtgtcagaaattcaagctcctctcc

SEQ ID NO: 436017 - DNA, 2688 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagaactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaatcaggacaggtgtttgtttttgttttcttttttataaatatgaatatatataatatatatgtccctgtacatatacaatgtgggtgctaatgtggagactgtggccggcctgagccaccaagctgcgggacccagagggagggattttactgcaagtcagcatcaaagcaccggtgttattctgaaaacaccagtggcctcatttttggcttttgcaaagcatgaattttttcatttggattgcactttcctggttcatgactgtacctgtaggtggttgttactttgactcttttcaggaaccaccccccaagctgaatttacaagttctgttagcactatttgcttcaacttactgcgatttgttctcaaaacttaaaaataagcaagcaaatggctgatactaccaagagaactggaagatggataccacacaaacttcttgtataaaaatatgaatgctgaaatgtttcagacatttttaatttaataaacctgtaaccacatttaagtgatctaaaacccatagcattgtagtcatggcaacccgctaaactttctcatgcaactaaaatttctgggggaaatgagggtgggggttgtacatttcccattgtaaaataagtgttttaaatgtcctgtactgctaacgaatgactttctatatgtccaggagttctccagtggaataactatgcactactttacatttcatggggatgcacaaaaacaaaaaagtattacatttttagttgctgtttgtaccaaccttaaattacatatgtttaacaacaacaaatcaaaaatcctatttctattgagtttttaatactgactagcaactctgaagtcttaattccttttttgttatgatttatttgtgagtttacatttttaaattgtttaactttcttaatttagtaattaaaaagagagcattttacatttgaaaaaaaaacaagcataatataaatatgattgaaaaaagatgattacaaaaatgatcttgaaaacaaataataacaaatagaataagaatacattgatataaagacattaagaaaaaaaaaaaaggggggggggcggaagaaaaattaacacggagagagggacctaaatatcggcacagacgccagctgtgttccaaaaaagaggccccataaaggagaatgataaaaaaaacagacgacgcacggccgataacaacacaaccgagagtggagacacaaaatcaacgccaggcagctaaagacaaagcaacccaatgtcgtgggggagaacacaaggaccaccacccacaagcaataacagccccgacaaacaacaaacgggagatgaatggtgcaaccacaaaaattgactgagaaaaacggacgataataaaaaaac

SEQ ID NO: 436018 - DNA, 1460 bp, Homo sapiens
cggagctggaggggcagagcatcagcaagagtagcagcgagcagccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtatgtttcattttgttttcacttaactacttgattttaaaagttgattgccgcaataaaatgccatcagcattgggcaggagggagaagaaattcacagcagtgattaaggctgagtttttcaggctttctgccccggtttttaccctgtgtaatacttgcactattattaacttaatgtttctcttgaagcctgctcacttattttgaaagaaaactttctatcaataccctaaatgaaaagccagtaaaacttgtcatagattaaaagtagccataaaaatatgaaatgctagctagagcatatattattgccaacccaagtttctaagcccgcagtccactccctctgttgggaagagaggggagagtagcaagtaattgccacagattaa

SEQ ID NO: 436019 - DNA, 3293 bp, Homo sapiens
gctcctacccataggggacagtgaggtgacaggctgaggcctggaaggatgatgaaagtgagaccgtcttagggcccttccagatagggaaccttctctgccccaatgccccacccctgccaccaatacacacgcttctgctgcctggggctctcctattggtcctcggggggatgtggtaagaactgctcacccagaaagtgcccgggtgcctgtttccccagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccctaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttatgtatga

SEQ ID NO: 436020 - DNA, 623 bp, Homo sapiens
gaagcttcgtcaacagatatgcggcggttgggcacgtcgggtgtgcgatgcacacgccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtttgggcactcggcgtgtgcacacgccgaggaaccaggcaacaacttcgtccacacggatctgcaacaactcgtatggttattcggcgtgtggcaacaacttcgtccataagacttgcaacaacttcgtccacaaggatctaccttaagaagtttggactctcggcgtgtgcagcaaccacttcgtccattcagacctctgggcttccgggtgtatggacactcggcgtgtgcatgcacacgccgagtatccataaccgtcgcatatcgcggtggacgaagttgtagctgcacacgccgaatccccaaaccccttggtgacacatgtcagaatggacgaagtagtaaggcaacaaattcgtacatagtgacatgttgacctctcggttaggacctcgg

SEQ ID NO: 436021 - DNA, 3583 bp, Homo sapiens
taggtaggagtagagagaccccaccttgtgggtaagtgaaaagaagaatatgtcatgtcccctatctgggaaatcttaagcaagagaagaaaccactgctaggctggttatactggctgtgacatgatggagaggcaggggaatcgctgaaatgacctagaagggcctcttaaactttctggttggaccgagcagaggagggagagagaggtgtgtctcttgtgaggtgggtgaacgtctttttattccctcccaatccaccaacttccgcccaagccaggatctgtcacaactcgagaggtggaaattccggtttccctggcctagagctcccagtgctggctttggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccctaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttatgtatga

SEQ ID NO: 436022 - DNA, 2349 bp, Homo sapiens
ggacacgcggggctggcggggactggggggacacgccgagctgcggggggcggggaggacacgcggggctggggggtcggggcgcccggggcgccccctgactccccctgtgcccccagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccctaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttatgtatga

SEQ ID NO: 436023 - DNA, 1671 bp, Homo sapiens
tactgacatattcactccaagagtcctcccatcctgcagtgggttcctccagggatggagtttccaggcagttttgaagctgctctggccattccgcgttcctctctctgttcctagtctcccctggcctaccttcttccctactgcacttcctcccttcctccttcctcttcccactttcagctcttttgaaggataatttttactttctctgctctcttaggaactcctggaagcaggacatggagcgggggaacccagagtgggcatgtgccagtggccccatgagcaggagccttcggcctcagagccgcccgcaaatcattaaagaagtcctggctgtccctaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttatgtatga

SEQ ID NO: 436024 - DNA, 3246 bp, Homo sapiens
taggtaggagtagagagaccccaccttgtgggtaagtgaaaagaagaatatgtcatgtcccctatctgggaaatcttaagcaagagaagaaaccactgctaggctggttatactggctgtgacatgatggagaggcaggggaatcgctgaaatgacctagaagggcctcttaaactttctggttggaccgagcagaggagggagagagaggtgtgtctcttgtgaggtgggtgaacgtctttttattccctcccaatccaccaacttccgcccaagccaggatctgtcacaactcgagaggtggaaattccggtttccctggcctagagctcccagtgctggctttggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggtaagtgtccgacagcaggaagtgtggggatagcaatagagagctggaggtgggtggaggaaggagagaggaacagaggaggggaggaaatggatatggagaaacagggacacagagagagatgccagggagaaacagaggatctcggagaaagagagacacagccagaaacagaagtccaaaaggaaagaaaagccactggagagcagattgaggaaaacaggtggccacggggccaggggcacgcttcttccagttctccatgttggtaatttttctttccttccttaaatatcactgtcaccaagctgggcacctcaaactcctaactgcttcacactcccaggtaccccaaagtcaaggcccatgctagaagaccatatgtggacccggtgacccggagctcgccaggcccatgccaaccacatagatcatgctggaccataccatgtccaggaccatgggatggctggttggagaatgggccctggaacccacacacaagcacagcttggctggtttcttactgagactgtggaggctgctggccccctcacctccagggagaagactcaggaaaggatgtagacactgtaggagttgtaggtgactgggcatggctgtgtctttagcatctttctggggcaattggtaaaagaaatgtatattgctcattgatgcagagacctcctctgtgttggatgctgggcgcacaaacacggataagcctcagcccctgccctcaaggtgttcacagtcacaagggggaagacatgagcaatcagaccatcaatacagggtgatctgttcagcaactgaggggtttatggcagctctgggggaggcctggcctccaggagatgctcctccctgaggctggcccttccatcccgcagccacaccagattccccaacttctcccctctgtactgtgtaagattccctgagcctgcaaaggtatcaattagctagtcagctttctaactaatgcaacagtgcaagtgctaatgagagaggatctgaggagctccttcctccttgccgatgtgccagtgggacaggaaaatacacccccacccaccccaccatgccaaggtcatggagaggacctaggtgagcctcccacacctggctcaccatccctgcccaggggacatccagccatgcccacatggatctttgaagaaaaatgcttcctctctgttcgtggtgactctactggtgggaatttcctttaacagaagaggaagaaagcaggggtggttggggggatggcgagagggactctgacatacgccctcctgtctgcatatagctttgctgcttgtggctgccaacactttcctgtttgtctgtctgcctgctgctcctcatcctagtgaggaccaaggcgtcctccccgacggtagccctccctgtcccaggcctggaagagcatccactgtgcctcactttatttcccgtccccattaccctgcctctggctgcctctcctctctactgcgggctcagcacacaacgctcttgtgttggggtggggtgaagggaagaactgctggtggaggagagtgcatctagctgccaaggcctggggagcacactcaggcaacccttccccttcccccacttttatctcaggagtcagctgcctgcccaccaagtcctcatcactctctctgtcttactcctccaacaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgtgagttctctggtgcccagcgctcaggcccccaagcatcccttctcacatctacccacgactttcctctgtagctctggaaaactctggccttccagatgcaggaccctcatgaacttcctggccccagaccaatttccctctatgtccctttcccttccttcctcaagcccctcatttcccagatgtgagaccttggcgttctggccccccagcctctctccccatttaggaacttcaagattcctacctgttgcccatctcggaggacaaggtcatggagggaaaaggccaaagcccctttgaccccgctcacaagcatacggctgtcttggtgggtgagtatcaggtttcccacttcatcccaacatctactttctccagtcacgctgtgaaatatggaatattacagagttttccaaaaggcaggggaaactgggtgtggtgatgcgtgcatatggtcccagttatttggaagctgaagttgaaggatgcttgagtttaggggtttgagtctagcctgggcaacacagcgagatcgtctc

SEQ ID NO: 436025 - DNA, 1437 bp, Homo sapiens
cccctgtccggtgcagactctgctggaagtcttggacgcctgggttagggtctccacttctgggctggggagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagtgtgagtactaccccccacactgagcacagtctacacatacataatgtgcatgaaaaaacacctatcatggcatagtaaatgcccaataaatgttagtgctctccaccccaccaatctcgcctgctcagacgtacacctggtatagctgcctatattccacatgtgcctagcacccttttatacacggagcagttgctggagcca

SEQ ID NO: 436026 - DNA, 1238 bp, Homo sapiens
cccctgtccggtgcagactctgctggaagtcttggacgcctgggttagggtctccacttctgggctggggagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggtgagcagcagggctggaccatgggggctggacacgggacttgacgccagtgaggccccagctcgtgagcggaggcaggaattgacatgagccagcacctactcagcactttcacataggaaggcattaaatcgtcaccacctctcaggaatttga

SEQ ID NO: 436027 - DNA, 396 bp, Homo sapiens
ggtggccaggtagacctcactgaggtgcttgatggatgtgagggaggcaggtgatgtgattttctacagaagcacccagccgcccactgtttcatgcctatggagaaatagctgggtttctccagggacaaagttttgtcagggagttgcaaaggaaggacaggggtccaagggattttagtcatttacaagagactgccatctccatggcacagaggaaggtgaatgatctggctgacccgcgcccagtacatatcaccctcagaaggagctttcttacagctggggaggcccccggaagttgggaagggatctgtggatgagatgagatgacttccactctctctgtctccccatagccacagggtcgctccacaaggctgtggtaagtgggga

SEQ ID NO: 436028 - DNA, 258 bp, Homo sapiens
aagccattctggccttggatatccaggatccaggggtccccaggctaaagaacatggtgaggagtccagggataaagagtgtgggctgggagtgaagagggggccggcagctaccctgggcttggctgcctgtgcatgaataacttagttgctgttatctgtaatcagcagttctctttatatgtatatcgtgacaatataacagacaggaaatgtcgtggcctcacttttttttttttttttgagatggagtcttgc

SEQ ID NO: 436029 - DNA, 244 bp, Homo sapiens
gcacttgtttgcacggttatctcctggattatgttctacagaggcgtacagggactgccccagcattacctagcctttctcctcagtgagggggcagcctctgggggtccagcaatttgagtcaggtggcctggagacctaaattctctgtctccctcagacacagtgtttcaacttcatccgtgtcctggtttcttacaatgtcacccatctctacacctgcggcaccttcgccttcagccct

SEQ ID NO: 436030 - DNA, 3139 bp, Homo sapiens
cccctgtccggtgcagactctgctggaagtcttggacgcctgggttagggtctccacttctgggctggggagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccctaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttatgtatga

SEQ ID NO: 436031 - DNA, 5511 bp, Homo sapiens
taggtaggagtagagagaccccaccttgtgggtaagtgaaaagaagaatatgtcatgtcccctatctgggaaatcttaagcaagagaagaaaccactgctaggctggttatactggctgtgacatgatggagaggcaggggaatcgctgaaatgacctagaagggcctcttaaactttctggttggaccgagcagaggagggagagagaggtgtgtctcttgtgaggtgggtgaacgtctttttattccctcccaatccaccaacttccgcccaagccaggatctgtcacaactcgagaggtggaaattccggtttccctggcctagagctcccagtgctggctttggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggtaagtgtccgacagcaggaagtgtggggatagcaatagagagctggaggtgggtggaggaaggagagaggaacagaggaggggaggaaatggatatggagaaacagggacacagagagagatgccagggagaaacagaggatctcggagaaagagagacacagccagaaacagaagtccaaaaggaaagaaaagccactggagagcagattgaggaaaacaggtggccacggggccaggggcacgcttcttccagttctccatgttggtaatttttctttccttccttaaatatcactgtcaccaagctgggcacctcaaactcctaactgcttcacactcccaggtaccccaaagtcaaggcccatgctagaagaccatatgtggacccggtgacccggagctcgccaggcccatgccaaccacatagatcatgctggaccataccatgtccaggaccatgggatggctggttggagaatgggccctggaacccacacacaagcacagcttggctggtttcttactgagactgtggaggctgctggccccctcacctccagggagaagactcaggaaaggatgtagacactgtaggagttgtaggtgactgggcatggctgtgtctttagcatctttctggggcaattggtaaaagaaatgtatattgctcattgatgcagagacctcctctgtgttggatgctgggcgcacaaacacggataagcctcagcccctgccctcaaggtgttcacagtcacaagggggaagacatgagcaatcagaccatcaatacagggtgatctgttcagcaactgaggggtttatggcagctctgggggaggcctggcctccaggagatgctcctccctgaggctggcccttccatcccgcagccacaccagattccccaacttctcccctctgtactgtgtaagattccctgagcctgcaaaggtatcaattagctagtcagctttctaactaatgcaacagtgcaagtgctaatgagagaggatctgaggagctccttcctccttgccgatgtgccagtgggacaggaaaatacacccccacccaccccaccatgccaaggtcatggagaggacctaggtgagcctcccacacctggctcaccatccctgcccaggggacatccagccatgcccacatggatctttgaagaaaaatgcttcctctctgttcgtggtgactctactggtgggaatttcctttaacagaagaggaagaaagcaggggtggttggggggatggcgagagggactctgacatacgccctcctgtctgcatatagctttgctgcttgtggctgccaacactttcctgtttgtctgtctgcctgctgctcctcatcctagtgaggaccaaggcgtcctccccgacggtagccctccctgtcccaggcctggaagagcatccactgtgcctcactttatttcccgtccccattaccctgcctctggctgcctctcctctctactgcgggctcagcacacaacgctcttgtgttggggtggggtgaagggaagaactgctggtggaggagagtgcatctagctgccaaggcctggggagcacactcaggcaacccttccccttcccccacttttatctcaggagtcagctgcctgcccaccaagtcctcatcactctctctgtcttactcctccaacaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgtgagttctctggtgcccagcgctcaggcccccaagcatcccttctcacatctacccacgactttcctctgtagctctggaaaactctggccttccagatgcaggaccctcatgaacttcctggccccagaccaatttccctctatgtccctttcccttccttcctcaagcccctcatttcccagatgtgagaccttggcgttctggccccccagcctctctccccatttaggaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccctaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttatgtatga

SEQ ID NO: 436032 - DNA, 3630 bp, Homo sapiens
gatactcagcgcagccttccagagctagtcagactggaggaggggacctgggaagctctggagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggtaagtgtccgacagcaggaagtgtggggatagcaatagagagctggaggtgggtggaggaaggagagaggaacagaggaggggaggaaatggatatggagaaacagggacacagagagagatgccagggagaaacagaggatctcggagaaagagagacacagccagaaacagaagtccaaaaggaaagaaaagccactggagagcagattgaggaaaacaggtggccacggggccaggggcacgcttcttccagttctccatgttggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgtgagttctctggtgcccagcgctcaggcccccaagcatcccttctcacatctacccacgactttcctctgtagctctggaaaactctggccttccagatgcaggaccctcatgaacttcctggccccagaccaatttccctctatgtccctttcccttccttcctcaagcccctcatttcccagatgtgagaccttggcgttctggccccccagcctctctccccatttaggaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccctaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttatgtatga

SEQ ID NO: 436033 - DNA, 2552 bp, Homo sapiens
cccctgtccggtgcagactctgctggaagtcttggacgcctgggttagggtctccacttctgggctggggagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccctaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactacaacggcctaagatcctcgagagta

SEQ ID NO: 436034 - DNA, 843 bp, Homo sapiens
cccctgtccggtgcagactctgctggaagtcttggacgcctgggttagggtctccacttctgggctggggagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgcgcatcacaatcctacaccgagatcagtctacgtccagattacg

SEQ ID NO: 436035 - DNA, 1202 bp, Homo sapiens
  misc_feature (170)..(170): n is a, c, g, or t
  misc_feature (984)..(984): n is a, c, g, or t
  misc_feature (1014)..(1014): n is a, c, g, or t
  misc_feature (1020)..(1020): n is a, c, g, or t
  misc_feature (1033)..(1033): n is a, c, g, or t
  misc_feature (1045)..(1045): n is a, c, g, or t
  misc_feature (1049)..(1049): n is a, c, g, or t
  misc_feature (1053)..(1053): n is a, c, g, or t
agcggagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgangacgcaagagcccgctctcacttttcagcggcaggcgaagggggctgaggaaaggagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctatgcctcaatgggtgtagcacncgtttagaagtcgatcttccgatgagcctnaagggntggacctacgaanaatcgctcggtngaangccngctggggacagcggcttccccaccccgtgtgggaaaagggccccatggcgcgcgactctggggaagctctgtgacatatccacagcctgttgtgcttaagccaaaagggcgcgcccctgctttagtgtagattattattatataaaact

SEQ ID NO: 436036 - DNA, 462 bp, Homo sapiens
gacacttttcctttttcagtaaaatgccttacttaaacacttgagtataaaagaagtttctgcttaaggcagtaaaggggactgacttgatgttctttctttctcacagttgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatctgca

SEQ ID NO: 436037 - DNA, 1266 bp, Homo sapiens
  misc_feature (170)..(170): n is a, c, g, or t
  misc_feature (891)..(891): n is a, c, g, or t
agcggagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgangacgcaagagcccgctctcacttttcagcggcaggcgaagggggctgaggaaagggcttttaagaactgtgctattgttgacttcttcacagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtaagtcaacatgctttgctttggttcggctttttgaaattagggaactgacttgatgaacagccccagttaactgattttataaagtttgcttatctgcntggcttgatcctcattctagtgcgttaatgttgtgcaatcggattgggtaatttggtcaatcagctggcattttggaagcaaggttcccaagtggccgaaattccgaagtgtgattgtattgtccattgcggcggaggggacgtgtgaaacaacattaagggaagcacatatttctagcacaaaaaaggggagcgacaaagaactcagtggcaccatgcgtacgacacttgtaagcggccacataggagtataataaagacggggatcaacatagaaaaaacatcatatgtataaccatcatgtatggtgaacgcactcagacagttgatgttgtagaaataggagtttcgaactagaggacgtaatcatagatg

SEQ ID NO: 436038 - DNA, 1398 bp, Homo sapiens
  misc_feature (170)..(170): n is a, c, g, or t
agcggagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgangacgcaagagcccgctctcacttttcagcggcaggcgaagggggctgaggaaaggaggtgggtctaggcaggggaaattggggtgccaccagacggagacagcttggactaccagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatctgcaaaaaaaaaacaaaagggcggccgc

SEQ ID NO: 436039 - DNA, 1409 bp, Homo sapiens
  misc_feature (170)..(170): n is a, c, g, or t
agcggagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgangacgcaagagcccgctctcacttttcagcggcaggcgaagggggctgaggaaaggaggtgggtctaggcaggggaaattggggtgccaccagacggagacagcttggactaccgcttttaagaactgtgctattgttgacttcttcacagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatctgca

SEQ ID NO: 436040 - DNA, 1316 bp, Homo sapiens
  misc_feature (170)..(170): n is a, c, g, or t
agcggagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgangacgcaagagcccgctctcacttttcagcggcaggcgaagggggctgaggaaaggagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatctgca

SEQ ID NO: 436041 - DNA, 1260 bp, Homo sapiens
  misc_feature (170)..(170): n is a, c, g, or t
  misc_feature (1042)..(1042): n is a, c, g, or t
  misc_feature (1072)..(1072): n is a, c, g, or t
  misc_feature (1078)..(1078): n is a, c, g, or t
  misc_feature (1091)..(1091): n is a, c, g, or t
  misc_feature (1103)..(1103): n is a, c, g, or t
  misc_feature (1107)..(1107): n is a, c, g, or t
  misc_feature (1111)..(1111): n is a, c, g, or t
agcggagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgangacgcaagagcccgctctcacttttcagcggcaggcgaagggggctgaggaaaggaggtgggtctaggcaggggaaattggggtgccaccagacggagacagcttggactaccagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctatgcctcaatgggtgtagcacncgtttagaagtcgatcttccgatgagcctnaagggntggacctacgaanaatcgctcggtngaangccngctggggacagcggcttccccaccccgtgtgggaaaagggccccatggcgcgcgactctggggaagctctgtgacatatccacagcctgttgtgcttaagccaaaagggcgcgcccctgctttagtgtagattattattatataaaact

SEQ ID NO: 436042 - DNA, 267 bp, Homo sapiens
tcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatctgcagtgtcctccctgcatgcct

SEQ ID NO: 436043 - DNA, 1289 bp, Homo sapiens
  misc_feature (170)..(170): n is a, c, g, or t
  misc_feature (914)..(914): n is a, c, g, or t
agcggagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgangacgcaagagcccgctctcacttttcagcggcaggcgaagggggctgaggaaaggaggtgggtctaggcaggggaaattggggtgccaccagacggagacagcttggactaccagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtaagtcaacatgctttgctttggttcggctttttgaaattagggaactgacttgatgaacagccccagttaactgattttataaagtttgcttatctgcntggcttgatcctcattctagtgcgttaatgttgtgcaatcggattgggtaatttggtcaatcagctggcattttggaagcaaggttcccaagtggccgaaattccgaagtgtgattgtattgtccattgcggcggaggggacgtgtgaaacaacattaagggaagcacatatttctagcacaaaaaaggggagcgacaaagaactcagtggcaccatgcgtacgacacttgtaagcggccacataggagtataataaagacggggatcaacatagaaaaaacatcatatgtataaccatcatgtatggtgaacgcactcagacagttgatgttgtagaaataggagtttcgaactagaggacgtaatcatagatg

SEQ ID NO: 436044 - DNA, 790 bp, Homo sapiens
  misc_feature (16)..(17): n is a, c, g, or t
  misc_feature (636)..(636): n is a, c, g, or t
  misc_feature (645)..(646): n is a, c, g, or t
  misc_feature (699)..(699): n is a, c, g, or t
  misc_feature (701)..(701): n is a, c, g, or t
tacggctaggtagagnngggtgggggaaaggaggtgggtctaggcaggggaaattggggtgccaccagacggagacagcttggactaccagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtagtcacatgcttgcnttggtcggnntttgaatagggactgcttgatgacaggccagtactgattataaagtgctatcngntggtgaacccatcaaggggtaaggggggcaccgtgtggcattgggcacagcggctttggaagcagtcccaggggaaaccccgcgtttgg

SEQ ID NO: 436045 - DNA, 1374 bp, Homo sapiens
  misc_feature (170)..(170): n is a, c, g, or t
agcggagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgangacgcaagagcccgctctcacttttcagcggcaggcgaagggggctgaggaaaggaggtgggtctaggcaggggaaattggggtgccaccagacggagacagcttggactaccagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatctgca

SEQ ID NO: 436046 - DNA, 1276 bp, Homo sapiens
  misc_feature (170)..(170): n is a, c, g, or t
agcggagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgangacgcaagagcccgctctcacttttcagcggcaggcgaagggggctgaggaaaggaggtgggtctaggcaggggaaattggggtgccaccagacggagacagcttggactaccgtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatctgca

SEQ ID NO: 436047 - DNA, 1261 bp, Homo sapiens
  misc_feature (170)..(170): n is a, c, g, or t
agcggagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgangacgcaagagcccgctctcacttttcagcggcaggcgaagggggctgaggaaaggaggtgggtctaggcaggggaaattggggtgccaccagacggagacagcttggactaccagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgtaactggaactgttgtaactggcgctgttgtaactggagctgttgtaactggggcgtgttgta

SEQ ID NO: 436048 - DNA, 854 bp, Homo sapiens
  misc_feature (170)..(170): n is a, c, g, or t
agcggagtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgangacgcaagagcccgctctcacttttcagcggcaggcgaagggggctgaggaaaggaggtgggtctaggcaggggaaattggggtgccaccagacggagacagcttggactaccgcttttaagaactgtgctattgttgacttcttcacagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtcccctggggctccaccgacccccggggcgccgagactttgtcgggccgcgaggggctggctttttttttgagccgccgccttgccctccccacccgcgccccggcctcactgctctttttctgcgctgtaaaccaaaaataaaattctaggcccccca

SEQ ID NO: 436049 - DNA, 1831 bp, Homo sapiens
ttacctatatgtggttccaccgcgtcgactagtacggttgggggttaccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacactactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccacaaaaacatttaatttatggatcctgcctcctgccacgtgctgggtggacctaaggttccttctccactccctgagtaattcatggcatttgggggctcaccccacctccaggtctgtcaagtggcctttgtccctggggctgatggcccccaactcaccagcatcatgaccttgtgccagtcctggtcctccctccccagccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggaaaaaaaaaagcacacaaaacacaacacagtgggcgccgcccagccccccggaaaagtctcaagaccactcgtttggggggcgccccacacgagtaagtaccctgccaagcggtcccacaggccccggcagcagcgtggtctcaccaaaacgcggggccgcgggtcgccaccgaggtcggcacggctcaaggcagcgcaaacccccggga

SEQ ID NO: 436050 - DNA, 1784 bp, Homo sapiens
ttacctatatgtggttccaccgcgtcgactagtacggttgggggttaccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacactactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccacaaaaacatttaatttatggatcctgcctcctgccacgtgctgggtggacctaaggttccttctccactccctgagtaattcatggcatttgggggctcaccccacctccaggtctgtcaagtggcctttgtccctggggctgatggcccccaactcaccagcatcatgaccttgtgccagtcctggtcctccctccccagccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggatgctgtctctagcgtggtcatgtgtctgatgtgtttaggggtggagatgagggtttctttccctgtcacagtcccagaagctttttttttccattttttcattttgcttgtttttctattgaggacggagtcatgctctgtcgccaaggctcgatcattgct

SEQ ID NO: 436051 - DNA, 1829 bp, Homo sapiens
ctgcctctggccgcgcggatcagcttccagcccagtcggcccggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacactactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccacaaaaacatttaatttatggatcctgcctcctgccacgtgctgggtggacctaaggttccttctccactccctgagtaattcatggcatttgggggctcaccccacctccaggtctgtcaagtggcctttgtccctggggctgatggcccccaactcaccagcatcatgaccttgtgccagtcctggtcctccctccccagccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggaaaaaaaaaagcacacaaaacacaacacagtgggcgccgcccagccccccggaaaagtctcaagaccactcgtttggggggcgccccacacgagtaagtaccctgccaagcggtcccacaggccccggcagcagcgtggtctcaccaaaacgcggggccgcgggtcgccaccgaggtcggcacggctcaaggcagcgcaaacccccggga

SEQ ID NO: 436052 - DNA, 1913 bp, Homo sapiens
ttacctatatgtggttccaccgcgtcgactagtacggttgggggttaccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacactactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccacaaaaacatttaatttatggatcctgcctcctgccacgtgctgggtggacctaaggttccttcccaccccattctggcgacacttggagccatctcaggcctcatgacttgaaggggagtggagggggagccgtgtctccccccctccactccctgagtaattcatggcatttgggggctcaccccacctccaggtctgtcaagtggcctttgtccctggggctgatggcccccaactcaccagcatcatgaccttgtgccagtcctggtcctccctccccagccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggaaaaaaaaaagcacacaaaacacaacacagtgggcgccgcccagccccccggaaaagtctcaagaccactcgtttggggggcgccccacacgagtaagtaccctgccaagcggtcccacaggccccggcagcagcgtggtctcaccaaaacgcggggccgcgggtcgccaccgaggtcggcacggctcaaggcagcgcaaacccccggga

SEQ ID NO: 436053 - DNA, 2232 bp, Homo sapiens
ctgcctctggccgcgcggatcagcttccagcccagtcggcccggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccgactggtcatgaggctcagagaggttcacgagcaaatgtgatgcccatagcagagccagggttcaagtggaagatccttggactctagagaacccccacctgacttcaaaccacggtgccctgctgcctcatgctgtctccccaggcctggtcccttagatgaggagaggacgtggccagagcccccacacccatcatccaggggtttgctcaaaccctgcaaagcgtagctgggcccgagccccgctgggtgctgaggaggtgatcaggcctgggtttgtgtgccgctctgcctgtcacccactgctggccttgggctggctctgtcccctccccagcctcccccagagccccccgcaagaggttgaggtgcatagccccgggctggcaaagtaccaagtgctgctggggcctggagctaccacatggcctcttgttgacagcgtccccctgtccccccgccacccccaggaggcagtcgggctccttcctcagcaccggctggttcaccatgatcctcgcgctggagctgtgtgaggagatcgtggtctatgggatggtcagcgacactactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccactccctgagtaattcatggcatttgggggctcaccccacctccaggtctgtcaagtggcctttgtccctggggctgatggcccccaactcaccagcatcatgaccttgtgccagtcctggtcctccctccccagccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggaaaaaaaaaagcacacaaaacacaacacagtgggcgccgcccagccccccggaaaagtctcaagaccactcgtttggggggcgccccacacgagtaagtaccctgccaagcggtcccacaggccccggcagcagcgtggtctcaccaaaacgcggggccgcgggtcgccaccgaggtcggcacggctcaaggcagcgcaaacccccggga

SEQ ID NO: 436054 - DNA, 1782 bp, Homo sapiens
ttacctatatgtggttccaccgcgtcgactagtacggttgggggttaccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagagggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacactactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccacaaaaacatttaatttatggatcctgcctcctgccacgtgctgggtggacctaaggttccttcccaccccattctggcgacacttggagccatctcaggcctccactccctgagtaattcatggcatttgggggctcaccccacctccaggtctgtcaagtggcctttgtccctggggctgatggcccccaactcaccagcatcatgaccttgtgccagtcctggtcctccctccccagccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggaaaaaaaaaagcacacaaaacacaacacagtgggcgccgcccagccccccggaaaagtctcaagaccactcgtttggggggcgccccacacgagtaagtaccctgccaagcggtcccacaggccccggcagcagcgtggtctcaccaaaacgcggggccgcgggtcgccaccgaggtcggcacggctcaaggcagcgcaaacccccggga

SEQ ID NO: 436055 - DNA, 1349 bp, Homo sapiens
ctgcctctggccgcgcggatcagcttccagcccagtcggcccggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaaggaggcagtcgggctccttcctcagcaccggctggttcaccatgatcctcgcgctggagctgtgtgaggagatcgtggtctatgggatggtcagcgacactactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccactccctgagtaattcatggcatttgggggctcaccccacctccaggtctgtcaagtggcctttgtccctggggctgatggcccccaactcaccagcatcatgaccttgtgccagtcctggtcctccctccccagccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggaaaaaaaaaagcacacaaaacacaacacagtgggcgccgcccagccccccggaaaagtctcaagaccactcgtttggggggcgccccacacgagtaagtaccctgccaagcggtcccacaggccccggcagcagcgtggtctcaccaaaacgcggggccgcgggtcgccaccgaggtcggcacggctcaaggcagcgcaaacccccggga

SEQ ID NO: 436056 - DNA, 980 bp, Homo sapiens
gcgtccatctctggcccagagtcatccagcttgcaagaggcagagcagtgactcgaaccctggctctcgggatctgctactcccctatgtgtcttggcctccccagggatcaggcgtgggtcttcacgagcccatggcctggcgaggggtggtcaaggtaggcggcagggtgtggccggagagtggggttctgtcccaccccagccctgttccccaccccgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccactccctgagtaattcatggcatttgggggctcaccccacctccaggtctgtcaagtggcctttgtccctggggctgatggcccccaactcaccagcatcatgaccttgtgccagtcctggtcctccctccccagccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggaaaaaaaaaagcacacaaaacacaacacagtgggcgccgcccagccccccggaaaagtctcaagaccactcgtttggggggcgccccacacgagtaagtaccctgccaagcggtcccacaggccccggcagcagcgtggtctcaccaaaacgcggggccgcgggtcgccaccgaggtcggcacggctcaaggcagcgcaaacccccggga

SEQ ID NO: 436057 - DNA, 732 bp, Homo sapiens
ctgcctctggccgcgcggatcagcttccagcccagtcggcccggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccggtaagtgggaagaaggaggacttccagggaacgcagaggccccgactggcggagcagctcagcagcctctccaccccaggacccactgccacttctgacctccctactgctgagcagagaagggcagaatggcctcaaagtccaaccctgttcttgcagaccgtgtggccccaggcaggtggcatccactctgcagtgtcagtaccttgctatccctgtaaaacggaggtaacgctacgagctcaccaggcaaagcctacgtggaactggggttgtgaagttcagttcagccgctcttgtctttactgcagaagccccgggctgtgagagagagagctggatgtggggggcagttcatctcgactgcctgagtcaaggtctctggttcctcatgggcaggggagcaggtgccaggcagaactccctcccctg

SEQ ID NO: 436058 - DNA, 1744 bp, Homo sapiens
ttacctatatgtggttccaccgcgtcgactagtacggttgggggttaccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacactactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccacaaaaacatttaatttatggatcctgcctcctgccacgtgctgggtggacctaaggttccttctccactccctgagtaattcatggcatttgggggctcaccccacctccaggtctgtcaagtggcctttgtccctggggctgatggcccccaactcaccaccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggatgctgtctctagcgtggtcatgtgtctgatgtgtttaggggtggagatgagggtttctttccctgtcacagtcccagaagctttttttttccattttttcattttgcttgtttttctattgaggacggagtcatgctctgtcgccaaggctcgatcattgct

SEQ ID NO: 436059 - DNA, 1867 bp, Homo sapiens
ctgcctctggccgcgcggatcagcttccagcccagtcggcccggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacactactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccacaaaaacatttaatttatggatcctgcctcctgccacgtgctgggtggacctaaggttccttcccaccccattctggcgacacttggagccatctcaggcctccactccctgagtaattcatggcatttgggggctcaccccacctccaggtctgtcaagtggcctttgtccctggggctgatggcccccaactcaccagcatcatgaccttgtgccagtcctggtcctccctccccagccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggaaaaaaaaaagcacacaaaacacaacacagtgggcgccgcccagccccccggaaaagtctcaagaccactcgtttggggggcgccccacacgagtaagtaccctgccaagcggtcccacaggccccggcagcagcgtggtctcaccaaaacgcggggccgcgggtcgccaccgaggtcggcacggctcaaggcagcgcaaacccccggga

SEQ ID NO: 436060 - DNA, 1762 bp, Homo sapiens
ctgcctctggccgcgcggatcagcttccagcccagtcggcccggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacactactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccactccctgagtaattcatggcatttgggggctcaccccacctccaggtctgtcaagtggcctttgtccctggggctgatggcccccaactcaccagcatcatgaccttgtgccagtcctggtcctccctccccagccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggaaaaaaaaaagcacacaaaacacaacacagtgggcgccgcccagccccccggaaaagtctcaagaccactcgtttggggggcgccccacacgagtaagtaccctgccaagcggtcccacaggccccggcagcagcgtggtctcaccaaaacgcggggccgcgggtcgccaccgaggtcggcacggctcaaggcagcgcaaacccccggga

SEQ ID NO: 436061 - DNA, 1568 bp, Homo sapiens
ctgcctctggccgcgcggatcagcttccagcccagtcggcccggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccgggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagccgccatgccgttgcgaggcctccgggatgtcccatcccaagccatcacactccactccctgagtaattcatggcatttgggggctcaccccacctccaggtctgtcaagtggcctttgtccctggggctgatggcccccaactcaccaccgcccctaccaccttttggtgccacacttctcaggctggccgccctggttggggcagccgagagcctggggttcattggtgaaggggccttggagttgtgactgccggggccgtatcaggaacgtacgggtaaacgtgtgttttctggatgctgtctctagcgtggtcatgtgtctgatgtgtttaggggtggagatgagggtttctttccctgtcacagtcccagaagctttttttttccattttttcattttgcttgtttttctattgaggacggagtcatgctctgtcgccaaggctcgatcattgct

SEQ ID NO: 436062 - DNA, 984 bp, Homo sapiens
  misc_feature (934)..(934): n is a, c, g, or t
ttacctatatgtggttccaccgcgtcgactagtacggttgggggttaccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagagggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacactactgcagaaaagagcacccntcaatgcttacactaattgaaaaggccggtaataggtgcaatgttcctgc

SEQ ID NO: 436063 - DNA, 364 bp, Homo sapiens
gcctactgcgaccagatcttccaggacgagacgggcaagaaccggtgagcctggggcctgcctgctggggtctctctggcagctggggccttccttctctgggagtctcttgtccatcaggggctgctctgtcaggcccgggaggtcagcactcatggaggcagacatggtcctgccctctaatggggggcaggaggcagaggggatgtcactcaggaaactgtcacacagatctagaatcccagatggtgttgagggctgtcaggccttttgagcacctgatgggaagcactagccagtgtgtaggggcatgagggagcacttctctctggagggaatggtctgtctaacttggtctctgata

SEQ ID NO: 436064 - DNA, 5536 bp, Homo sapiens
  misc_feature (2302)..(2302): n is a, c, g, or t
ggccttcgggagggggacagaacttaggagtcagccctctgccttcgtacaaaggctcgcttctcctcagggcgtctctgggtggagcgaagcggccgaggggaccacgacaatgtccctttgcttttcggaccgatggccaggcctccagagccaggagcgcccgggaccccagggcagggagcaaagctcataccgcaaccccgccacccgcccgcgccctgccagcctgttggggccacagcgcgcaggccagcagccgcactcgccgctgcggggttccctttgcgctgagctcatctcctgcaacgccgctgccccaaaccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgcagttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactacgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctganggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtcccagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaagattcagaccccactccggtgaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgagatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgccggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatga

SEQ ID NO: 436065 - DNA, 1261 bp, Homo sapiens
gcaaatataaatgctaaaggacttgaatttttaataaaaagaaaacccaccttgaaccaggttgcaatataacacatgtaattacatctccttcaactgcgtaacagaatggttgtcaagccttcctgcatatttctcatttgctttctatagatttcacctttacaactttcttcctctggcaatccccaaataatttacaccaaatatctgtgtgagcttgtttcagacttattgttgttgatgatattaaatcattttggggaggagactgatcagaagcgatgaagcaatgatatgcatgctgtaccctctggccacctccaccttagcgcaaagtggaaactgctttctagcttttgctctcagcttctctctgcttcatctgttgggcataagggatgaaattcgcaacaggggaaacctatggtttcttcctctcctctcactgaggttctctgtagcccaactgatttattcaaagcttctatagcttttataaaatagtattttataaaaagtgctttcaacattatttctgctctaacgataaacctgtttgtttccttataacctatttccacttaataggaccatatttcctcgttagtatctgttatgaatatatttcatttttaacgtggcatttaaaaggtaaagtgcttaacttaaaatgtttccatccctgggtgccaggtaccccttcaagtaccaaattgtatttttggcagaagaaagaacagtttccttctcaaatccctggtccacatctcttcaagttccatagtttgtatcgaagccattcctaacagctgtatttgtttctattctaaaacccaagatccaattcaagacttcaacaaacggagggttttggggcagttgagtcaaggggtatcttggaggcagggattctgatagtaacttagtaatgacttctcccacatagtgacaataatcagaaaaccttgtgatacaggtaaaagtggaatatggctgtgtattagttacctactgctgtgtaagaaattgcccaaaccctcagcagtgtaagataacatttagtctcacagtttctgtgagtcaggaatccaagtgtgtcttcaccgagctccctcaggcatggagtctctcacaaggctgcaatcaggtaatggccaaactgcagtgatcacaaggctcagctcggggaagacacagcccaagcatgctcacatgggctacaggcaagactaatgtctctggccaacagccctcaagg

SEQ ID NO: 436066 - DNA, 5471 bp, Homo sapiens
  misc_feature (2302)..(2302): n is a, c, g, or t
ggccttcgggagggggacagaacttaggagtcagccctctgccttcgtacaaaggctcgcttctcctcagggcgtctctgggtggagcgaagcggccgaggggaccacgacaatgtccctttgcttttcggaccgatggccaggcctccagagccaggagcgcccgggaccccagggcagggagcaaagctcataccgcaaccccgccacccgcccgcgccctgccagcctgttggggccacagcgcgcaggccagcagccgcactcgccgctgcggggttccctttgcgctgagctcatctcctgcaacgccgctgccccaaaccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgcagttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactacgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctganggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtcccagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaagattcagaccccactccggtgaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgagatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgccggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatga

SEQ ID NO: 436067 - DNA, 5617 bp, Homo sapiens
  misc_feature (2383)..(2383): n is a, c, g, or t
ggccttcgggagggggacagaacttaggagtcagccctctgccttcgtacaaaggctcgcttctcctcagggcgtctctgggtggagcgaagcggccgaggggaccacgacaatgtccctttgcttttcggaccgatggccaggcctccagagccaggagcgcccgggaccccagggcagggagcaaagctcataccgcaaccccgccacccgcccgcgccctgccagcctgttggggccacagcgcgcaggccagcagccgcactcgccgctgcggggttccctttgcgctgagctcatctcctgcaacgccgctgccccaaaccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgcagttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactacgatgtgaatgaggaggaagctgaataccttccgggtgaaccagaggaggcattgaatggccacagcagcattgatgtttccttccaatccaaagtggatacaaagcctttagagggtaggatctcccctccagattctgatctgtcctcccccttgcatccaacacctacttattggccattctatcctgaaacagaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctganggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtcccagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaagattcagaccccactccggtgaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgagatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgccggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatga

SEQ ID NO: 436068 - DNA, 5632 bp, Homo sapiens
  misc_feature (2302)..(2302): n is a, c, g, or t
ggccttcgggagggggacagaacttaggagtcagccctctgccttcgtacaaaggctcgcttctcctcagggcgtctctgggtggagcgaagcggccgaggggaccacgacaatgtccctttgcttttcggaccgatggccaggcctccagagccaggagcgcccgggaccccagggcagggagcaaagctcataccgcaaccccgccacccgcccgcgccctgccagcctgttggggccacagcgcgcaggccagcagccgcactcgccgctgcggggttccctttgcgctgagctcatctcctgcaacgccgctgccccaaaccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgcagttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactacgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctganggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtcccagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaagattcagaccccactccggtgaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgagatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgccggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatgacttaaggatctatattgtctctaggacaaagctgggggttggcatatatgccttaaccacaaaggagaaaggtgatttatgcaaacatacagtaca

SEQ ID NO: 436069 - DNA, 4956 bp, Homo sapiens
  misc_feature (2302)..(2302): n is a, c, g, or t
ggccttcgggagggggacagaacttaggagtcagccctctgccttcgtacaaaggctcgcttctcctcagggcgtctctgggtggagcgaagcggccgaggggaccacgacaatgtccctttgcttttcggaccgatggccaggcctccagagccaggagcgcccgggaccccagggcagggagcaaagctcataccgcaaccccgccacccgcccgcgccctgccagcctgttggggccacagcgcgcaggccagcagccgcactcgccgctgcggggttccctttgcgctgagctcatctcctgcaacgccgctgccccaaaccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgcagttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactacgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctganggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtcccagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaagattcagaccccactccggtgaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgagatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgccggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaggaagtagtacagtatttaaggaggcttgagttacaatcagacctggccctaagacagtacttcaaggaaagaagataagggtttgcatagcgtcctacatcaagtgacattt

SEQ ID NO: 436070 - DNA, 3353 bp, Homo sapiens
  misc_feature (2302)..(2302): n is a, c, g, or t
ggccttcgggagggggacagaacttaggagtcagccctctgccttcgtacaaaggctcgcttctcctcagggcgtctctgggtggagcgaagcggccgaggggaccacgacaatgtccctttgcttttcggaccgatggccaggcctccagagccaggagcgcccgggaccccagggcagggagcaaagctcataccgcaaccccgccacccgcccgcgccctgccagcctgttggggccacagcgcgcaggccagcagccgcactcgccgctgcggggttccctttgcgctgagctcatctcctgcaacgccgctgccccaaaccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgcagttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactacgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctganggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtcccagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaagattcagaccccactccggtgaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatctgtgagttccaaaatcattttcctgtgtggccaaaatggtgctctttaatcttgctctttaatctgtcagtgttttgacttctgctattcagaggctctg

SEQ ID NO: 436071 - DNA, 836 bp, Homo sapiens
tctctcacaaggctgcaatcaggtaatggccaaactgcagtgatcacaaggctcagctcggggaagacacagcccaagcatgctcacatgggctacaggcaagactaatgtctctggccaacagccctcaaggacatcagttccttggcacatgttcccctttacagggtagcttgcaacatggcatccagcttccctcaaagggagcaagagagagcccctaaggcagaaaccagttttttgagaccgaatatcggcagtgatagcctatcacttctgctatactctatgcactagaagaagcaagacactactaatgcagcccaaactcaaggggattgcttaaggctataatacatgaggagatggagatcactgggggctgcttagatgctgcctaccacaggctacatggctattcttttacaatcttgatttttaacttacagcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggtaatactactgatggaatgcaaatagataacctctcatcacagtgaatgtgagcactaacagattttactacaaaatgaaatcccatcacttagatctcctttctttggtctgtaaacttttaagtactagtaaatttaagtactagtaaatgagtcttaaaatgaactttctggggtttgggtggagggaaggatatatcaagcagtaagtttgtactgcttgcctg

SEQ ID NO: 436072 - DNA, 5392 bp, Homo sapiens
  misc_feature (2302)..(2302): n is a, c, g, or t
ggccttcgggagggggacagaacttaggagtcagccctctgccttcgtacaaaggctcgcttctcctcagggcgtctctgggtggagcgaagcggccgaggggaccacgacaatgtccctttgcttttcggaccgatggccaggcctccagagccaggagcgcccgggaccccagggcagggagcaaagctcataccgcaaccccgccacccgcccgcgccctgccagcctgttggggccacagcgcgcaggccagcagccgcactcgccgctgcggggttccctttgcgctgagctcatctcctgcaacgccgctgccccaaaccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgcagttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactacgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctganggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtcccagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaagattcagaccccactccggtgaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatctatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgagatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgccggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatga

SEQ ID NO: 436073 - DNA, 4333 bp, Homo sapiens
ggccttcgggagggggacagaacttaggagtcagccctctgccttcgtacaaaggctcgcttctcctcagggcgtctctgggtggagcgaagcggccgaggggaccacgacaatgtccctttgcttttcggaccgatggccaggcctccagagccaggagcgcccgggaccccagggcagggagcaaagctcataccgcaaccccgccacccgcccgcgccctgccagcctgttggggccacagcgcgcaggccagcagccgcactcgccgctgcggggttccctttgcgctgagctcatctcctgcaacgccgctgccccaaaccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgcagttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgaggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtcccagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaagattcagaccccactccggtgaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgagatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgccggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatga

SEQ ID NO: 436074 - DNA, 1168 bp, Homo sapiens
atcactgggggctgcttagatgctgcctaccacaggctacatggctattcttttacaatcttgatttttaacttacagcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatga

SEQ ID NO: 436075 - DNA, 584 bp, Homo sapiens
acgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagaggtaagtgaccagggatatttgactgctgaggaaattgaaggatgggcttaaattctggggcagcgacccagggactggctcggagttgtttctgagcctactcttgcgctgaacctgaccttggaggcagcagggctggagtggcttgggagtgaggaaagacgttgtctctaggcatcttctgaggccctggcaggtggtcactcccttgaggaaaaaaatgcttagcggatatgagagcgggagtgcagatgtgggagcccctttgaacataaggcaatttactgtttggttgcttatttttagaaccatctctaagtatacaagtatttctaattatatgttcattgaaggggaaaaaatcagaaaatacagataattttaaaaaagaa

SEQ ID NO: 436076 - DNA, 971 bp, Homo sapiens
tagtggcgcatgcctgtaatcccagctacttgtgaggctgaggcaggagaatcccttgaacccagaaggcagaggttgcagtgtgcagtgagctgagattgtgccattgcactccagcctgggcaacatgagcgaaactccatctcaaaaaaacaaaaacaaaaaacaaactcaaattagcatgatagatcaggctacttagattcagctttctgagatgttatttgttaacattaaggctaatttattataatgaaaatgtaaactttgaggtatgttaatatataaacatctttttcctttggcctaaaaggtctttagtattcagcacactgggtaaagttcagtttagacacaatcaaattggcatcttttaaacataagtgaaatatagagagcttgaacttgagttacttaaagaagatacagtataattaattatacagaacaaaacaaagatgtgtttagagtgactctggcctgactcttgtccatcagcccctagtagcctatcttcagcctttgggaagtcttaacttcccaggttaaactagaatattctggaactgagctgtccaaatttcatcttaaagtggatcatttgactctgaaacacgattctcatggcagaaaaagccctggtgtttccttggagctggggataaaggccagtgagccagcctgtgatgagagctgcccctggcactatctgagtggaaagctcattgggacagccatgcagctatcagagccgactgaagccctgtcccttacccctcaggcacctgatgcttaacttgcctcctgggaaataatgatctagcatttacttggaacaatgattaatcatgttctttaataattgctgacatttgtattttaagctgtataccaatgttcgtatttgacattgattttctaaccattagagatatttaattaaaacttggaaatgaaagaaaaaaaaaaaa

SEQ ID NO: 436077 - DNA, 2095 bp, Homo sapiens
cacgcgtcggagaaactccatctctactaaaagtacaaaattagcccgagtagctgggactatgcaccaccatgcctggctaatttttttaattttttgtagagacagggttttgccatgttgcccaggctggtctcaaactcctagactcaggcaatctgcccacctcggcctcccaaggtgctgggatgataggcatgagccaccgcacccagcctatctcctagatcttgaatcaaaaataaaatgtaaatcacttccattctgctagcatgagggtttgttgctaaaattgaggattctatctgacgtttactttttgttgttttttgagacaaggtcttgctttgtcgcccatgctggagtgcagtggcatcattataactcactgtcaaactcctggactccaatgttccctccccttttagcctcccaagtagctgggtctacaggcatgaaccatcaggcccagataattaaaaaaactttttttggtgaaaacatgatcttgctatgttgctcaggctggttgtctggcattttctttgtcctttattctttatactagctaaaccctggagtatccttgaagcctttactggcatacagagtacctgaatcttactttggagcctagcatgggtcataaatatatctgattcattaacctgtgagacagctgagagaacacagactccttacctgtatctccaggcatatctggtttttctctgcctaatagattttcctgctttctagttagtaatattgagaaagaagaaaggcttatttatcatttgctttttttccactgtgaatcatctgttctttccatgaacattctggggagcacctcctgattaaactcctgtctccctgaccactatcctgctgtcattggacttcttgaagcacatgggctactgccccaggacactgggatttgagaggagtttagtggtaattgtcaggtctttcaaagcatttattattccttttatacggagatttcagtattgagacttaaaatgaactgaaaaatgagattgaacatttaatattttggatgtaacttttgaagaaagtatgctttggtgcttaaaattgtatatgattttaggtaagaaactttgataatattggcataatttagatttattttctttcttttttttgagacagtctcgctcagtcgcccaggctgaagtgcagtgagctgagattgtgccattgcactccagcctgggcaacatgagcgaaactccatctcaaaaaaacaaaaacaaaaaacaaactcaaattagcatgatagatcaggctacttagattcagctttctgagatgttatttgttaacattaaggctaatttattataatgaaaatgtaaactttgaggtatgttaatatataaacatctttttcctttggcctaaaaggtctttagtattcagcacactgggtaaagttcagtttagacacaatcaaattggcatcttttaaacataagtgaaatatagagagcttgaacttgagttacttaaagaagatacagtataattaattatacagaacaaaacaaagatgtgtttagagtgactctggcctgactcttgtccatcagcccctagtagcctatcttcagcctttgggaagtcttaacttcccaggttaaactagaatattctggaactgagctgtccaaatttcatcttaaagtggatcatttgactctgaaacacgattctcatggcagaaaaagccctggtgtttccttggagctggggataaaggccagtgagccagcctgtgatgagagctgcccctggcactatctgagtggaaagctcattgggacagccatgcagctatcagagccgactgaagccctgtcccttacccctcaggcacctgatgcttaacttgcctcctgggaaataatgatctagcatttacttggaacaatgattaatcatgttctttaataattgctgacatttgtattttaagctgtataccaatgttcgtatttgacattgattttctaaccattagagatatttaattaaaacttggaaatgaaagaaaaaaaaaaaa

SEQ ID NO: 436078 - DNA, 1799 bp, Homo sapiens
gcatgcctgtgatcccagctacttgtgaggctgaggcaggagaatcccttgaacccagaaggcagagggtgcagtggcatcattataactcactgtcaaactcctggactccaatgttccctccccttttagcctcccaagtagctgggtctacaggcatgaaccatcaggcccagataattaaaaaaactttttttggtgaaaacatgatcttgctatgttgctcaggctggttgtctggcattttctttgtcctttattctttatactagctaaaccctggagtatccttgaagcctttactggcatacagagtacctgaatcttactttggagcctagcatgggtcataaatatatctgattcattaacctgtgagacagctgagagaacacagactccttacctgtatctccaggcatatctggtttttctctgcctaatagattttcctgctttctagttagtaatattgagaaagaagaaaggcttatttatcatttgctttttttccactgtgaatcatctgttctttccatgaacattctggggagcacctcctgattaaactcctgtctccctgaccactatcctgctgtcattggacttcttgaagcacatgggctactgccccaggacactgggatttgagaggagtttagtggtaattgtcaggtctttcaaagcatttattattccttttatacggagatttcagtattgagacttaaaatgaactgaaaaatgagattgaacatttaatattttggatgtaacttttgaagaaagtatgctttggtgcttaaaattgtatatgattttaggtaagaaactttgataatattggcataatttagatttattttctttcttttttttgagacagtctcgctcagtcgcccaggctgaagtgcagtgagctgagattgtgccattgcactccagcctgggcaacatgagcgaaactccatctcaaaaaaacaaaaacaaaaaacaaactcaaattagcatgatagatcaggctacttagattcagctttctgagatgttatttgttaacattaaggctaatttattataatgaaaatgtaaactttgaggtatgttaatatataaacatctttttcctttggcctaaaaggtctttagtattcagcacactgggtaaagttcagtttagacacaatcaaattggcatcttttaaacataagtgaaatatagagagcttgaacttgagttacttaaagaagatacagtataattaattatacagaacaaaacaaagatgtgtttagagtgactctggcctgactcttgtccatcagcccctagtagcctatcttcagcctttgggaagtcttaacttcccaggttaaactagaatattctggaactgagctgtccaaatttcatcttaaagtggatcatttgactctgaaacacgattctcatggcagaaaaagccctggtgtttccttggagctggggataaaggccagtgagccagcctgtgatgagagctgcccctggcactatctgagtggaaagctcattgggacagccatgcagctatcagagccgactgaagccctgtcccttacccctcaggcacctgatgcttaacttgcctcctgggaaataatgatctagcatttacttggaacaatgattaatcatgttctttaataattgctgacatttgtattttaagctgtataccaatgttcgtatttgacattgattttctaaccattagagatatttaattaaaacttggaaatgaaagaaaaaaaaaaaa

SEQ ID NO: 436079 - DNA, 2041 bp, Homo sapiens
cacgcgtcggagaaactccatctctactaaaagtacaaaattagcccgagtagctgggactatgcaccaccatgcctggctaatttttttaattttttgtagagacagggttttgccatgttgcccaggctggtctcaaactcctagactcaggcaatctgcccacctcggcctcccaaggtgctgggatgataggcatgagccaccgcacccagcctatctcctagatcttgaatcaaaaataaaatgtaaatcacttccattctgctagcatgagggtttgttgctaaaattgaggattctatctgacgtttactttttgttgttttttgagacaaggtcttgctttgtcgcccatgctggagtgcagtggcatcattataactcactgtcaaactcctggactccaatgttccctccccttttagcctcccaagtagctgggtctacaggcatgaaccatcaggcccagataattaaaaaaactttttttggtgtttattctttatactagctaaaccctggagtatccttgaagcctttactggcatacagagtacctgaatcttactttggagcctagcatgggtcataaatatatctgattcattaacctgtgagacagctgagagaacacagactccttacctgtatctccaggcatatctggtttttctctgcctaatagattttcctgctttctagttagtaatattgagaaagaagaaaggcttatttatcatttgctttttttccactgtgaatcatctgttctttccatgaacattctggggagcacctcctgattaaactcctgtctccctgaccactatcctgctgtcattggacttcttgaagcacatgggctactgccccaggacactgggatttgagaggagtttagtggtaattgtcaggtctttcaaagcatttattattccttttatacggagatttcagtattgagacttaaaatgaactgaaaaatgagattgaacatttaatattttggatgtaacttttgaagaaagtatgctttggtgcttaaaattgtatatgattttaggtaagaaactttgataatattggcataatttagatttattttctttcttttttttgagacagtctcgctcagtcgcccaggctgaagtgcagtgagctgagattgtgccattgcactccagcctgggcaacatgagcgaaactccatctcaaaaaaacaaaaacaaaaaacaaactcaaattagcatgatagatcaggctacttagattcagctttctgagatgttatttgttaacattaaggctaatttattataatgaaaatgtaaactttgaggtatgttaatatataaacatctttttcctttggcctaaaaggtctttagtattcagcacactgggtaaagttcagtttagacacaatcaaattggcatcttttaaacataagtgaaatatagagagcttgaacttgagttacttaaagaagatacagtataattaattatacagaacaaaacaaagatgtgtttagagtgactctggcctgactcttgtccatcagcccctagtagcctatcttcagcctttgggaagtcttaacttcccaggttaaactagaatattctggaactgagctgtccaaatttcatcttaaagtggatcatttgactctgaaacacgattctcatggcagaaaaagccctggtgtttccttggagctggggataaaggccagtgagccagcctgtgatgagagctgcccctggcactatctgagtggaaagctcattgggacagccatgcagctatcagagccgactgaagccctgtcccttacccctcaggcacctgatgcttaacttgcctcctgggaaataatgatctagcatttacttggaacaatgattaatcatgttctttaataattgctgacatttgtattttaagctgtataccaatgttcgtatttgacattgattttctaaccattagagatatttaattaaaacttggaaatgaaagaaaaaaaaaaaa

SEQ ID NO: 436080 - DNA, 2027 bp, Homo sapiens
cacgcgtcggagaaactccatctctactaaaagtacaaaattagcccgagtagctgggactatgcaccaccatgcctggctaatttttttaattttttgtagagacagggttttgccatgttgcccaggctggtctcaaactcctagactcaggcaatctgcccacctcggcctcccaaggtgctgggatgataggcatgagccaccgcacccagcctatctcctagatcttgaatcaaaaataaaatgtaaatcacttccattctgctagcatgagggtttgttgctaaaattgaggattctatctgacgtttactttttgttgttttttgagacaaggtcttgctttgtcgcccatgctggagtgcagtggcatcattataactcactgtcaaactcctggactccaatgttccctccccttttagcctcccaagtagctgggtctacaggcatgaaccatcaggcccagataattaaaaaaactttttttggtgaaaacatgatcttgctatgttgctcaggctggttgtctggcattttctttgtcctttattctttatactagctaaaccctggagtatccttgaagcctttactggcatacagagtacctgaatcttactttggagcctagcatgggtcataaatatatctgattcattaacctgtgagacagctgagagaacacagactccttacctgtatctccaggcatatctggtttttctctgcctaatagattttcctgctttctagttagtaatattgagaaagaagaaaggcttatttatcatttgctttttttccactgtgaatcatctgttctttccatgaacattctggggagcacctcctgattaaactcctgtctccctgaccactatcctgctgtcattggacttcttgaagcacatgggctactgccccaggacactgggatttgagaggagtttagtggtaattgtcaggtctttcaaagcatttattattccttttatacggagatttcagtattgagacttaaaatgaactgaaaaatgagattgaacatttaatattttggatgtaacttttgaagaaagtatgctttggtgcttaaaattgtatatgattttaggtaagaaactttgataatgtgcagtgagctgagattgtgccattgcactccagcctgggcaacatgagcgaaactccatctcaaaaaaacaaaaacaaaaaacaaactcaaattagcatgatagatcaggctacttagattcagctttctgagatgttatttgttaacattaaggctaatttattataatgaaaatgtaaactttgaggtatgttaatatataaacatctttttcctttggcctaaaaggtctttagtattcagcacactgggtaaagttcagtttagacacaatcaaattggcatcttttaaacataagtgaaatatagagagcttgaacttgagttacttaaagaagatacagtataattaattatacagaacaaaacaaagatgtgtttagagtgactctggcctgactcttgtccatcagcccctagtagcctatcttcagcctttgggaagtcttaacttcccaggttaaactagaatattctggaactgagctgtccaaatttcatcttaaagtggatcatttgactctgaaacacgattctcatggcagaaaaagccctggtgtttccttggagctggggataaaggccagtgagccagcctgtgatgagagctgcccctggcactatctgagtggaaagctcattgggacagccatgcagctatcagagccgactgaagccctgtcccttacccctcaggcacctgatgcttaacttgcctcctgggaaataatgatctagcatttacttggaacaatgattaatcatgttctttaataattgctgacatttgtattttaagctgtataccaatgttcgtatttgacattgattttctaaccattagagatatttaattaaaacttggaaatgaaagaaaaaaaaaaaa

SEQ ID NO: 436081 - DNA, 2014 bp, Homo sapiens
cacgcgtcggagaaactccatctctactaaaagtacaaaattagcccgagtagctgggactatgcaccaccatgcctggctaatttttttaattttttgtagagacagggttttgccatgttgcccaggctggtctcaaactcctagactcaggcaatctgcccacctcggcctcccaaggtgctgggatgataggcatgagccaccgcacccagcctatctcctagatcttgaatcaaaaataaaatgtaaatcacttccattctgctagcatgagggtttgttgctaaaattgaggattctatctgacgtttactttttgttgttttttgagacaaggtcttgctttgtcgcccatgctggagtgcagtggcatcattataactcactgtcaaactcctggactccaatgttccctccccttttagcctcccaagtagctgggtctacaggcatgaaccatcaggcccagataattaaaaaaactttttttggtgaaaacatgatcttgctatgttgctcaggctggttgtctggcattttctttgtcctttattctttatactagctaaaccctggagtatccttgaagcctttactggcatacagagtacctgaatcttactttggagcctagcatgggtcataaatatatctgattcattaacctgtgagacagctgagagaacacagactccttacctgtatctccaggcatatctggtttttctctgcctaatagattttcctgctttctagttagtaatattgagaaagaagaaaggcttatttatcatttgctttttttccactgtgaatcatctgttctttccatgaacattctggggagcacctcctgattaaactcctgtctccctgaccactatcctgctgtcattggacttcttgaagcacatgggctactgccccaggacactgggatttgagaggagtttagtggtaattgtcaggtctttcaaagcatttattattccttttatacggagatttcagtattgagacttaaaatgaactgaaaaatgagattgaacatttaatattttggatgtaacttttgaagaaagtatgctttggtgcttaaaattgtatatgattttaggtaagaaactttgataatattggcataatttagatttattttctttcttttttttgagacagtctcgctcagtcgcccaggctgaagtgcagtgagctgagattgtgccattgcactccagcctgggcaacatgagcgaaactccatctcaaaaaaacaaaaacaaaaaacaaactcaaattagcatgatagatcaggctacttagattcagctttctgagatgttatttgttaacattaaggctaatttattataatgaaaatgtaaactttgaggtatgttaatatataaacatctttttcctttggcctaaaaggtctttagtattcagcacactgggtaaagttcagtttagacacaatcaaattggcatcttttaaacataagtgaaatatagagagcttgaacttgagttacttaaagaagatacagtataattaattatacagaacaaaacaaagatgtgtttagagtgactctggcctgactcttgtccatcagcccctagtagcctatcttcagcctttgggaagtcttaacttcccaggttaaactagaatattctggaactgagctgtccaaatttcatcttaaagtggatcatttgactctgaaacacgattctcatggcagaaaaagccctggtgtttccttggagctggggataaaggccagtgagccagccctgtcccttacccctcaggcacctgatgcttaacttgcctcctgggaaataatgatctagcatttacttggaacaatgattaatcatgttctttaataattgctgacatttgtattttaagctgtataccaatgttcgtatttgacattgattttctaaccattagagatatttaattaaaacttggaaatgaaagaaaaaaaaaaaa

SEQ ID NO: 436082 - DNA, 1700 bp, Homo sapiens
cacgcgtcggagaaactccatctctactaaaagtacaaaattagcccgagtagctgggactatgcaccaccatgcctggctaatttttttaattttttgtagagacagggttttgccatgttgcccaggctggtctcaaactcctagactcaggcaatctgcccacctcggcctcccaaggtgctgggatgataggcatgagccaccgcacccagcctatctcctagatcttgaatcaaaaataaaatgtaaatcacttccattctgctagcatgagggtttgttgctaaaattgaggattctatctgacgtttactttttgttgttttttgagacaaggtcttgctttgtcgcccatgctggagtgcagtggcatcattataactcactgtcaaactcctggactccaatgttccctccccttttagcctcccaagtagctgggtctacaggcatgaaccatcaggcccagataattaaaaaaactttttttggtgaaaacatgatcttgctatgttgctcaggctggttgtctggcattttctttgtcctttattctttatactagctaaaccctggagtatccttgaagcctttactggcatacagagtacctgaatcttactttggagcctagcatgggtcataaatatatctgattcattaacctgtgagacagctgagagaacacagactccttacctgtatctccaggcatatctggtttttctctgcctaatagattttcctgctttctagttagtaatattgagaaagaagaaaggcttatttatcatttgctttttttccactgtgaatcatctgttctttccatgaacattctggggagcacctcctgattaaactcctgtctccctgaccactatcctgctgtcattggacttcttgaagcacatgggctactgccccaggacactgggatttgagaggagtttagtggtaattgtcaggtctttcaaagcatttattattccttttatacggagatttcagtattgagacttaaaatgaactgaaaaatgagattgaacatttaatattttggatgtaacttttgaagaaagtatgctttggtgcttaaaattgtatatgattttaggtaagaaactttgataatattggcataatttagatttattttctttcttttttttgagacagtctcgctcagtcgcccaggctgaagtgcagtgacacagtctcagctcactgcaacgtctgcctcccggattgaagtgactctcgtgcctctgccacagagtggctgggattacaggcatgcaccaccacacaccgctaattttttgtatttttggtggagacggagtttcaccatgttggccaggctgcgaactcctgagctcaggtgatcctcccacctcagcttcccaaagtgctggcattacaggcatgagccaccacacctcaccagatttttaaaaaatatataactgcatctctcttgattctggggcttggtaaaaatggatagataagatagtattctaaattcaaattcgtggctaggcacagtggcccacacctgtaatcccagcactttgggattccagacagaagactcacttgagtacagtatgagaccagcctgggcaacatagatcttgcctctacaaaaaaaaaaaaaaatagccaggtgtggcacatgcctgtagtctcag

SEQ ID NO: 436083 - DNA, 1089 bp, Homo sapiens
  misc_feature (41)..(41): n is a, c, g, or t
  misc_feature (61)..(62): n is a, c, g, or t
  misc_feature (73)..(73): n is a, c, g, or t
  misc_feature (75)..(75): n is a, c, g, or t
attaaaaaatttgtagaattcaactcttatggagttatgantatattacatatagattgannattgaggtagncncaaatccatctctttcttcataaagcagttgttttgtcactttgactatattaagacacatcagtgtagcacatgctcttaactggctgtggcattttaattttataaaagaatggtttttatctgaagaactagatagaaaccccagtttttgtgccgttcagtcacccagatccttaaacttaactatggtacataatatccacacttagaactaacaggtgtttagtcactttaggacttaaaatggaaagttttttttttttcctgctgtatctctgctttcaactgaagttaaagaattctagatagtttaaaatgtgttagggataagcacacttcaaaagatgttttctagccctaaattttatgacattgggtacttaaatttggagtacactagctattgagaacaatattttgggttgaggagagatggttgaggccattatttagtgggagcattggcattttgaacactgtaaacaaaagaacacttccgcctgctgtttgtaaaagctctttgggaagatcttttacgaagaccaactttttaaaatgtaaattacctacctaatataagtgtcctaagacatgtatgtaaacttccggaactgttttgtctgtgtatttagaaaatacacaagaatctttattcaaacctaaaaatataaacttgtgagcactaaactgcttctggctttgtgaattttattgactgacatttaattcagatttctttgcaagtgtactaatttagactaattggggtaaggggaacaccttaatgaactttgacttatgtataattcagatatctttgtacttaaggcttacaagtttgaattatggaatactataagggttttttgtttatttgtatgtttttatatgaaagtacataaatgacagactacctccaagtaatcctgctttaattaatagcagtgatttgtaatcagtgtatcttttaagattctctacaggttttagaaaatattaaaaattccctgt

SEQ ID NO: 436084 - DNA, 7993 bp, Homo sapiens
cggtccgttgttcatttgccattcgacctccgccagggcctggtcggacggaaacgctccgccggctttattgtcgcttcgttatgtggcggagccgagcagtttagcgtgcctctcaccctcagcgcctgcgaagccggcggcggcgtcgggactcctcggcgcgcggaggaaggatatctgtgtggaggatcggtgtgtgcgcgcgcggctttaaagagggggcagcggagggtctccccgcactccgctgctcaacttcgaaggcctcgctcgctgcaggctcgctcctcacctctccgccgcccgcccccttctccgcgcgggacgctgcccggagcgcggcggggcgggggtggaggacgagagagcggtcggaggcgtcggcccggcagcggcagcggcagcggacgcgtgcagcagacccgggagcgagcgcgagccgggctgccgggcgagagggcgaggccgagccccgcgagaccggaacgccgggggcgggggcgagacagagggggagccgcggggagcgcgcgggacgcggcccgaggccgtgcgcgagccggggcaccgggcggcggcggcggcggcgcgcgccatgtcgttcagtgaaatgaaccgcaggacgctggcgttccgaggaggcgggttggtcaccgctagcggcggcggctccacgaacaataacgctggcggggaggcctcagcttggcctccgcagccccagccgagacagcccccgccgacagcgccgcccgcgcttcagccgcctaatgggcggggggccgacgaggaagtggaattggagggcctggagccccaagacctggaggcctccgccgggccggccgccggcgccgccgaggaagccaaggagttgctgctcccccaagacgcgggcggccccacctcgcttggcggtggcgcggggggccccctgctagcggaaaggaaccgtcggactctggccttccgaggcggcggcggcgggggtctcggcaacaatggcagtagccgcggccgccccgagacctcggtgtggcccttgaggcatttcaatgggcgagggccggcgactgtggatctggagctggacgcgctggaggggaaggagttgatgcaggacggcgcgtccctgagcgacagcaccgaggacgaggaggagggggcgagcctgggcgacggcagcggggcggaaggcggcagctgcagcagcagcaggcggtcgggcggcgatggcggggacgaagtggagggcagcggtgtgggagctggcgaaggagagactgtccagcacttcccgctcgcgcggcccaagtctctaatgcagaagctccaatgctccttccagacctcctggctcaaggactttccctggctgcgctattccaaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaccgagcacaaactccacgaagccaacgccccaggagtcagaaataccatcagaggaggggtactgggactttaataggaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtccttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaatcccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggtacactacgggattgttgtgcttttgtttggttttagttggaaataaggtttgatgtagatggcttgttactgttaatttaaaatattctataattgtccattactttatgttgtgttgtgacagatttggctatatttttagtcaattgaaatatgatactttaaaagtttgtttttaggtaatccaaaggaaaagtgtttatactcttgaatatattagcctcagcctatataaaaatttctttgaagtaaacattttaccggaaacagaattgacagatttttctacttgctgactgcctaacttattttgtttcatgatctcgagggactgccttttcccatctagatcttttaaaaaaatagttttagtactaaggtatactactggacatttctatttttttaagtgtattctttttctgacttacagtaaaatttcaggaagttgatagatactaagaacttatgattggtctcagaggtaacaatgaaatactcataattttgtctgtggaactctggcagaattatgttacacatttggcgaagttgtctcttgtaatttatattttaaatgaaaaagtattttagagcttttaatgaaggggaagagtataaactttctttcatattcactctgtagttacagaccgtctcataaatcaagattgtgcattattagagttctcagagacagatacttccatatggacccctgttcatttttcttatttactagatattttgctaaatttagcacactagcaattaagagtttaaaaaagaagaaacgttataggaaagggaaactgaacagtaatgagtagctttgaaattggggaaaacacactagctgggttaggtacagctatcctaatggagaagagtgagctaaatgcgttaattcatgtaaagtgcttagaacactggtacataataggtgcataacacatcttaaagttgtttaataatagataagaaccaagaggaaaaagaaataagaaaagatgggggaaaggaaggagaaaataggaaatgaaaggattaggacttgggcatttatattaatacaaaatggtgtaaacggcctgaatatcactgtagtagtatcatacgggggaaagtgtgatggaaaataggtttaaaaatcttaatttttaaaactttagtaagctttatttatattttttaggattttctgaacatagcatgaagggtttagattcatttttctgaaaaacgattaaaaaaactaccaattttttttttgagtgcccacacttgccgttgtgctgtatacatgattttaccttaatcctctataaggtaggtgctaatggtctccattttatagatgaggaaaggctcagagaaattcagaaacttggctaatttaacacagctgtgacagagctcgaatttgaccacgtctgattctgaagcccatactctttcagggaggctctattgctgcctcattaaacaactcttgtagaatttcagctcttaatggagtctatggatctatatttttcctataagacagctgtgtttagaattttgagtgtctttcctccccccaataaatttccttactactctttcttcataaagcagttgttttgtcactttgactatattaagacacatcagtgtagcacatgctcttaactggctgtggcattttaattttataaaagaatggtttttatctgaagaactagatagaaaccccagtttttgtgccgttcagtcacccagatccttaaacttaactatggtacataatatccacacttagaactaacaggtgtttagtcactttaggacttaaaatggaaagttttttttttttcctgctgtatctctgctttcaactgaagttaaagaattctagatagtttaaaatgtgttagggataagcacacttcaaaagatgttttctagccctaaattttatgacattgggtacttaaatttggagtacactagctattgagaacaatattttgggttgaggagagatggttgaggccattatttagtgggagcattggcattttgaacactgtaaacaaaagaacacttccgcctgctgtttgtaaaagctctttgggaagatcttttacgaagaccaactttttaaaatgtaaattacctacctaatataagtgtcctaagacatgtatgtaaacttccggaactgttttgtctgtgtatttagaaaatacacaagaatctttattcaaacctaaaaatataaacttgtgagcactaaactgcttctggctttgtgaattttattgactgacatttaattcagatttctttgcaagtgtactaatttagactaattggggtaaggggaacaccttaatgaactttgacttatgtataattcagatatctttgtacttaaggcttacaagtttgaattatggaatactataagggttttttgtttatttgtatgtttttatatgaaagtacataaatgacagactacctccaagtaatcctgctttaattaatagcagtgatttgtaatcagtgtatcttttaagattctctacaggttttagaaaatattaaaaattccctgt

SEQ ID NO: 436085 - DNA, 5119 bp, Homo sapiens
cggtccgttgttcatttgccattcgacctccgccagggcctggtcggacggaaacgctccgccggctttattgtcgcttcgttatgtggcggagccgagcagtttagcgtgcctctcaccctcagcgcctgcgaagccggcggcggcgtcgggactcctcggcgcgcggaggaaggatatctgtgtggaggatcggtgtgtgcgcgcgcggctttaaagagggggcagcggagggtctccccgcactccgctgctcaacttcgaaggcctcgctcgctgcaggctcgctcctcacctctccgccgcccgcccccttctccgcgcgggacgctgcccggagcgcggcggggcgggggtggaggacgagagagcggtcggaggcgtcggcccggcagcggcagcggcagcggacgcgtgcagcagacccgggagcgagcgcgagccgggctgccgggcgagagggcgaggccgagccccgcgagaccggaacgccgggggcgggggcgagacagagggggagccgcggggagcgcgcgggacgcggcccgaggccgtgcgcgagccggggcaccgggcggcggcggcggcggcgcgcgccatgtcgttcagtgaaatgaaccgcaggacgctggcgttccgaggaggcgggttggtcaccgctagcggcggcggctccacgaacaataacgctggcggggaggcctcagcttggcctccgcagccccagccgagacagcccccgccgacagcgccgcccgcgcttcagccgcctaatgggcggggggccgacgaggaagtggaattggagggcctggagccccaagacctggaggcctccgccgggccggccgccggcgccgccgaggaagccaaggagttgctgctcccccaagacgcgggcggccccacctcgcttggcggtggcgcggggggccccctgctagcggaaaggaaccgtcggactctggccttccgaggcggcggcggcgggggtctcggcaacaatggcagtagccgcggccgccccgagacctcggtgtggcccttgaggcatttcaatgggcgagggccggcgactgtggatctggagctggacgcgctggaggggaaggagttgatgcaggacggcgcgtccctgagcgacagcaccgaggacgaggaggagggggcgagcctgggcgacggcagcggggcggaaggcggcagctgcagcagcagcaggcggtcgggcggcgatggcggggacgaagtggagggcagcggtgtgggagctggcgaaggagagactgtccagcacttcccgctcgcgcggcccaagtctctaatgcagaagctccaatgctccttccagacctcctggctcaaggactttccctggctgcgctattccaaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaccgagcacaaactccacgaagccaacgccccaggagtcagaaataccatcagaggaggggtactgggactttaataggaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtccttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaatcccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggta

SEQ ID NO: 436086 - DNA, 7944 bp, Homo sapiens
cggtccgttgttcatttgccattcgacctccgccagggcctggtcggacggaaacgctccgccggctttattgtcgcttcgttatgtggcggagccgagcagtttagcgtgcctctcaccctcagcgcctgcgaagccggcggcggcgtcgggactcctcggcgcgcggaggaaggatatctgtgtggaggatcggtgtgtgcgcgcgcggctttaaagagggggcagcggagggtctccccgcactccgctgctcaacttcgaaggcctcgctcgctgcaggctcgctcctcacctctccgccgcccgcccccttctccgcgcgggacgctgcccggagcgcggcggggcgggggtggaggacgagagagcggtcggaggcgtcggcccggcagcggcagcggcagcggacgcgtgcagcagacccgggagcgagcgcgagccgggctgccgggcgagagggcgaggccgagccccgcgagaccggaacgccgggggcgggggcgagacagagggggagccgcggggagcgcgcgggacgcggcccgaggccgtgcgcgagccggggcaccgggcggcggcggcggcggcgcgcgccatgtcgttcagtgaaatgaaccgcaggacgctggcgttccgaggaggcgggttggtcaccgctagcggcggcggctccacgaacaataacgctggcggggaggcctcagcttggcctccgcagccccagccgagacagcccccgccgacagcgccgcccgcgcttcagccgcctaatgggcggggggccgacgaggaagtggaattggagggcctggagccccaagacctggaggcctccgccgggccggccgccggcgccgccgaggaagccaaggagttgctgctcccccaagacgcgggcggccccacctcgcttggcggtggcgcggggggccccctgctagcggaaaggaaccgtcggactctggccttccgaggcggcggcggcgggggtctcggcaacaatggcagtagccgcggccgccccgagacctcggtgtggcccttgaggcatttcaatgggcgagggccggcgactgtggatctggagctggacgcgctggaggggaaggagttgatgcaggacggcgcgtccctgagcgacagcaccgaggacgaggaggagggggcgagcctgggcgacggcagcggggcggaaggcggcagctgcagcagcagcaggcggtcgggcggcgatggcggggacgaagtggagggcagcggtgtgggagctggcgaaggagagactgtccagcacttcccgctcgcgcggcccaagtctctaatgcagaagctccaatgctccttccagacctcctggctcaaggactttccctggctgcgctattccaaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaccgagcacaaactccacgaagccaacgccccaggagtcagaaataccatcagaggaggggtactgggactttaataggaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtccttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaatcccattggttctattttcttgtatttttccatttaatttgcttcataacttaaaccaagtctcttctagtcttaggtattatttctcgattttgtgctgatgggcatgtttataagaactggactttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggtacactacgggattgttgtgcttttgtttggttttagttggaaataaggtttgatgtagatggcttgttactgttaatttaaaatattctataattgtccattactttatgttgtgttgtgacagatttggctatatttttagtcaattgaaatatgatactttaaaagtttgtttttaggtaatccaaaggaaaagtgtttatactcttgaatatattagcctcagcctatataaaaatttctttgaagtaaacattttaccggaaacagaattgacagatttttctacttgctgactgcctaacttattttgtttcatgatctcgagggactgccttttcccatctagatcttttaaaaaaatagttttagtactaaggtatactactggacatttctatttttttaagtgtattctttttctgacttacagtaaaatttcaggaagttgatagatactaagaacttatgattggtctcagaggtaacaatgaaatactcataattttgtctgtggaactctggcagaattatgttacacatttggcgaagttgtctcttgtaatttatattttaaatgaaaaagtattttagagcttttaatgaaggggaagagtataaactttctttcatattcactctgtagttacagaccgtctcataaatcaagattgtgcattattagagttctcagagacagatacttccatatggacccctgttcatttttcttatttactagatattttgctaaatttagcacactagcaattaagagtttaaaaaagaagaaacgttataggaaagggaaactgaacagtaatgagtagctttgaaattggggaaaacacactagctgggttaggtacagctatcctaatggagaagagtgagctaaatgcgttaattcatgtaaagtgcttagaacactggtacataataggtgcataacacatcttaaagttgtttaataatagataagaaccaagaggaaaaagaaataagaaaagatgggggaaaggaaggagaaaataggaaatgaaaggattaggacttgggcatttatattaatacaaaatggtgtaaacggcctgaatatcactgtagtagtatcatacgggggaaagtgtgatggaaaataggtttaaaaatcttaatttttaaaactttagtaagctttatttatattttttaggattttctgaacatagcatgaagggtttagattcatttttctgaaaaacgattaaaaaaactaccaattttttttttgagtgcccacacttgccgttgtgctgtatacatgattttaccttaatcctctataaggtaggtgctaatggtctccattttatagatgaggaaaggctcagagaaattcagaaacttggctaatttaacacagctgtgacagagctcgaatttgaccacgtctgattctgaagcccatactctttcagggaggctctattgctgcctcattaaacaactcttgtagaatttcagctcttaatggagtctatggatctatatttttcctataagacagctgtgtttagaattttgagtgtctttcctccccccaataaatttccttactactctttcttcataaagcagttgttttgtcactttgactatattaagacacatcagtgtagcacatgctcttaactggctgtggcattttaattttataaaagaatggtttttatctgaagaactagatagaaaccccagtttttgtgccgttcagtcacccagatccttaaacttaactatggtacataatatccacacttagaactaacaggtgtttagtcactttaggacttaaaatggaaagttttttttttttcctgctgtatctctgctttcaactgaagttaaagaattctagatagtttaaaatgtgttagggataagcacacttcaaaagatgttttctagccctaaattttatgacattgggtacttaaatttggagtacactagctattgagaacaatattttgggttgaggagagatggttgaggccattatttagtgggagcattggcattttgaacactgtaaacaaaagaacacttccgcctgctgtttgtaaaagctctttgggaagatcttttacgaagaccaactttttaaaatgtaaattacctacctaatataagtgtcctaagacatgtatgtaaacttccggaactgttttgtctgtgtatttagaaaatacacaagaatctttattcaaacctaaaaatataaacttgtgagcactaaactgcttctggctttgtgaattttattgactgacatttaattcagatttctttgcaagtgtactaatttagactaattggggtaaggggaacaccttaatgaactttgacttatgtataattcagatatctttgtacttaaggcttacaagtttgaattatggaatactataagggttttttgtttatttgtatgtttttatatgaaagtacataaatgacagactacctccaagtaatcctgctttaattaatagcagtgatttgtaatcagtgtatcttttaagattctctacaggttttagaaaatattaaaaattccctgt

SEQ ID NO: 436087 - DNA, 5249 bp, Homo sapiens
cggtccgttgttcatttgccattcgacctccgccagggcctggtcggacggaaacgctccgccggctttattgtcgcttcgttatgtggcggagccgagcagtttagcgtgcctctcaccctcagcgcctgcgaagccggcggcggcgtcgggactcctcggcgcgcggaggaaggatatctgtgtggaggatcggtgtgtgcgcgcgcggctttaaagagggggcagcggagggtctccccgcactccgctgctcaacttcgaaggcctcgctcgctgcaggctcgctcctcacctctccgccgcccgcccccttctccgcgcgggacgctgcccggagcgcggcggggcgggggtggaggacgagagagcggtcggaggcgtcggcccggcagcggcagcggcagcggacgcgtgcagcagacccgggagcgagcgcgagccgggctgccgggcgagagggcgaggccgagccccgcgagaccggaacgccgggggcgggggcgagacagagggggagccgcggggagcgcgcgggacgcggcccgaggccgtgcgcgagccggggcaccgggcggcggcggcggcggcgcgcgccatgtcgttcagtgaaatgaaccgcaggacgctggcgttccgaggaggcgggttggtcaccgctagcggcggcggctccacgaacaataacgctggcggggaggcctcagcttggcctccgcagccccagccgagacagcccccgccgacagcgccgcccgcgcttcagccgcctaatgggcggggggccgacgaggaagtggaattggagggcctggagccccaagacctggaggcctccgccgggccggccgccggcgccgccgaggaagccaaggagttgctgctcccccaagacgcgggcggccccacctcgcttggcggtggcgcggggggccccctgctagcggaaaggaaccgtcggactctggccttccgaggcggcggcggcgggggtctcggcaacaatggcagtagccgcggccgccccgagacctcggtgtggcccttgaggcatttcaatgggcgagggccggcgactgtggatctggagctggacgcgctggaggggaaggagttgatgcaggacggcgcgtccctgagcgacagcaccgaggacgaggaggagggggcgagcctgggcgacggcagcggggcggaaggcggcagctgcagcagcagcaggcggtcgggcggcgatggcggggacgaagtggagggcagcggtgtgggagctggcgaaggagagactgtccagcacttcccgctcgcgcggcccaagtctctaatgcagaagctccaatgctccttccagacctcctggctcaaggactttccctggctgcgctattccaaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaccgagcacaaactccacgaagccaacgccccaggagtcagaaataccatcagaggaggggtactgggactttaataggaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtccttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaatcccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttttatccaattatccttcttaaataatagttacaatggaacaaacaaaaaaaaaaaagtgtgggggctcgggcggaaagtttaaacatgtgtgggcgggcggaaaggaaggtaaggttcaagggcggggaaggggttttcacaaagccgggggggtgaaacacagtgggctggtaagggtgg

SEQ ID NO: 436088 - DNA, 3507 bp, Homo sapiens
atatggataattatgacatttatccctcattaagctgcctatcagtttgatttggacaacttgacatttatttgagacattaagctactttctggtaatatattaggcatttctgcaatagctctttcaggtaactgaatattattaagcatagttttatcttgctttgattaaacctcttaggcaaaaaatggaacttcataagctaatacattagaaaggggttatgattataaatcagaaatgcttgtgacattaagaaatgaggcacttgtgaaatttctttgaaatagccagctcctctaatgtgtcttcaaaatataaagtgattcacaaaggcatgcatcacacctatttgtagcagcccattcattacataaaccagggcatacctgtgtgggctctgtgagtgaagggaggcttcactactttctgtgagcagtaaggactggtatctttctgtgagcaataaggactggataaagactgcatatccttgtgtcgtgtcagcaccaatacaataaggagggttttaatgtgaagcaggcaatcttccagccccttctggtcttggatgaaatagttgcacagagtattgcaccaaaaatacacaatggaggctgaaaagttcaacatattttaagtcaattaatcaaattgcattgattcttgatgctttcttagaggcctacatgatttcttagattgctctgataaactatcataaggggtccacctcccctcatttagctcccccagggatttcttttcccccatgtcatacacccagtcctaaatcaacccccaaggctatccttccatcccttctgcagagggaacttttgtcagactctgcaacaaactcctagctctatccagagtgtcctctgctgctaagattggtatctttctcctcaaaagcctggatggtgaatgggggtgcattagtcagaattctccagagaaacagaaaaaataagattcgcgtgtgtgtgcaaacatatatataaataaataaaaatatatttattttaaggaattgactcacatgattttgaaggcaggcaagcccaaagtctgcaaggggtgggccagcagagagctggtgctacagtgcgggtctgaaagttgccagagtcccttttatagagaagcttaaaaaatatttgttgaattaaatgtcttaggtagagacaaattgaattaaagtggttaagtaaatactcttaggtgaaatttgtgcaaattatgagtataaagagggtgagctacagaactctccatgaccactcaagaatgggacccaaaggcaaatgataacttattcattcatcaagggataaacttgagttatcaaatggttaatagataaagatcccactctgccttggatttagccatcgcagtccctgtgtaaaaccccaccggctttcaggcatggaaaaaaatttcacaaaggccttgaaagaaggcatatgaagaccaaaaggatattgagcagggttccatacttgaataaaggaagaaactcccttcaatgtttactaagaaatagttagaatatagcatatcctgtatagatgaaatgtcctagcgaaaatgtttaaatgtatttaaagaagagctagattttgtggggggagagaagggaataggataggctggtgggaggaagaatgaaaagaagaaaacttgttggaaattttggagtagattgtgaggaggggtgactcactttaaagatgtatcatttggaggtagacacgattttcagagcacaaaacagataaggaaagatgtatgctgattgtgtggagcccaagggaaggcggggttttggagtcttacgtggctttgtttctgaaagggagacatgtgaagcctactcctgaggcgggaggctggggacatgaccatcaagacctataattgataaacaactaggggctgggtgctgcacttacatgctggggaaatagaaaatgaagcagacatgtgtcccatcttcttccagctttcagtctagcttggaaataaatctcatacctagagaaaatggaggatctgtgggatgtagatgaggtgggagcatgaatgcctagggagggaagaagaaagattttcagttcttcagctcttcctcatgaccctatctcatgccatgagcaattgtctggcatctcctgtgggttggaccactgctgcatttcttacttgccaacatcactttgtcccaaatgccattcctttgttccagggcctccttgtcttccgtctggggaactggaggtgagaagcattataatagcctctctgcctttatctacaatctctccaacctgtgctttatgctgatgtcaggatgggcgttgatggatgcttctatcactgtcggggcagggagggccagaacactagcataagatgtcaatatgtctatccatatgtcaggtccatactcaactcaagcttctggttaactgctgatctattggcaactccagttcccaataagttcctcatctccttctgagaccacctcagtgtggacttaatcgtccacatcactgtcagcattttggttaaaaccattcaacaagtctccaggaagctccaaactttccttcatcttcctgtcttcttctgagccctccaaactcttccaacctctacccgttacccagttccaaaggtgcttccacactttcaagtatctttatagcaatgccccactcctggtaccaaattcctgtattagtctgttttcacactgctatgaagacatacttgagactcggtaatttatatagaaaagaggtttaattgacaaaaaagctaacaaagtgagccctgattcaaaaatgactgtctacacttggcacatgagggactttatgatattaagagattaattaaacaacagtggatggggaggaagaacagacttttgagctcttcccaatataggaatgtgttagttctaaaaattttcttaagttgtttgcttggaactcagagtatatttttccatacgaaaaattcagaactattttatttatgatatgggctaaaaagacttctgtaatctagcttggaaacttaataatcattaaacttattttcaatgagatacgactgtttaaattctgaaacctggaaccctctgttgccctgcaaatgctttaggaaaagaagagtgtgtctgatggaggataagatggaaagtgaatatggatccatattcagaagacacggttgcattacagcaaaggaacagctttttgctggccatgctaagcatttgacattgatgtgggagaacatggcattcagtatgactctgtctggatatatatagttttgtaaattgggtgttcttaagttgagactgcatgtttcattccaaaatcaatcttagttttcccacttgcattagcatattgtattagtccgtcttcacactgctataaagacatacccgagactgggtaatttataaagaaaaga

SEQ ID NO: 436089 - DNA, 2771 bp, Homo sapiens
agcactctccagcctctcaccgcaaaattacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgtaaggtcatgctggtgggttagctaaaccaagaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaaaagtaccacacaaactatgggatccaaggggcagtcttgcaacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattccc

SEQ ID NO: 436090 - DNA, 1048 bp, Homo sapiens
  misc_feature (1037)..(1037): n is a, c, g, or t
ttcatttccaagtctcgcggttgtcgtccattttgaaatgttcgcccgaagcggtccttcgcgatacgagtgcgcctgcacaacaatctcgaaattcagagtgttcaaccaatggccgcccaggtcatgtctgtgctaacccccggaggtcactttggcaccgctacccattacagtgagcatgcattctgactgattaacacacatcaccaacccgacacagcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatgaaaatttcgcccaaggtgancctactttggg

SEQ ID NO: 436091 - DNA, 390 bp, Homo sapiens
cgtcgactgctggccaatctctctaacctcagcctaggtaatttggtggcttgctgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattccc

SEQ ID NO: 436092 - DNA, 858 bp, Homo sapiens
taacattttctttccttctggtttcaggtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctgtgagtatctcatgggtagactccagtttacacttttaagtccatcttaccatgggtgtttctggcaacttgaacagattagcacatggttcagtgaaacttccttgtgcaattttctcctctggttatttgttctcttgtggagaaccttggattgctgcttaggttaagaaccctcatctgcttcattgttcaaaaccagtgctcctgggtagctaccaagtggcagtgcatatctgttagtagcacgtgtgtacaagacacttcaagaaggcagaaaggtaggagttctcagaaagatgaaaccactgccacaatgcacatcattattgtgattctcacttaattgttgttctttcccaatatactcggtttggtggaaggacatgctcttttgcatccctgagtagctttcctagacccacaagggccagacaggacagctgggtggtaggcatgaggttctgtgttttacatcacagcgtggccacacaaaccagtgcagacatgagagcccagacacctctaatttatcaacataccgtcgagcttggcccaggggacatccatcagaactcctgtttagggacaaa

SEQ ID NO: 436093 - DNA, 422 bp, Homo sapiens
caattaccggagtcagcgcgcacacggggggaagagtaagcatcagagacacagctcacagcggacagaagtacaagaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagcggttgtggaacgctgccctctgcccacacgctgcgttcactgccaatgctgtactcacctccatcaccctccaactttggggcccatgtcttccttgggccaaggtctcatgggggctgggcc

SEQ ID NO: 436094 - DNA, 2720 bp, Homo sapiens
agcactctccagcctctcaccgcaaaattacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgtaaggtcatgctggtgggttagctaaaccaagaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaagttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattccc

SEQ ID NO: 436095 - DNA, 5910 bp, Homo sapiens
agcactctccagcctctcaccgcaaaattacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgtaaggtcatgctggtgggttagctaaaccaagaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaaaagtaccacacaaactatgggatccaaggggcagtcttgcaacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaaaagctgcctatcagtttgatttggacaacttgacatttatttgagacattaagctactttctggtaatatattaggcatttctgcaatagctctttcaggtaactgaatattattaagcatagttttatcttgctttgattaaacctcttaggcaaaaaatggaacttcataagctaatacattagaaaggggttatgattataaatcagaaatgcttgtgacattaagaaatgaggcacttgtgaaatttctttgaaatagccagctcctctaatgtgtcttcaaaatataaagtgattcacaaaggcatgcatcacacctatttgtagcagcccattcattacataaaccagggcatacctgtgtgggctctgtgagtgaagggaggcttcactactttctgtgagcagtaaggactggtatctttctgtgagcaataaggactggataaagactgcatatccttgtgtcgtgtcagcaccaatacaataaggagggttttaatgtgaagcaggcaatcttccagccccttctggtcttggatgaaatagttgcacagagtattgcaccaaaaatacacaatggaggctgaaaagttcaacatattttaagtcaattaatcaaattgcattgattcttgatgctttcttagaggcctacatgatttcttagattgctctgataaactatcataaggggtccacctcccctcatttagctcccccagggatttcttttcccccatgtcatacacccagtcctaaatcaacccccaaggctatccttccatcccttctgcagagggaacttttgtcagactctgcaacaaactcctagctctatccagagtgtcctctgctgctaagattggtatctttctcctcaaaagcctggatggtgaatgggggtgcattagtcagaattctccagagaaacagaaaaaataagattcgcgtgtgtgtgcaaacatatatataaataaataaaaatatatttattttaaggaattgactcacatgattttgaaggcaggcaagcccaaagtctgcaaggggtgggccagcagagagctggtgctacagtgcgggtctgaaagttgccagagtcccttttatagagaagcttaaaaaatatttgttgaattaaatgtcttaggtagagacaaattgaattaaagtggttaagtaaatactcttaggtgaaatttgtgcaaattatgagtataaagagggtgagctacagaactctccatgaccactcaagaatgggacccaaaggcaaatgataacttattcattcatcaagggataaacttgagttatcaaatggttaatagataaagatcccactctgccttggatttagccatcgcagtccctgtgtaaaaccccaccggctttcaggcatggaaaaaaatttcacaaaggccttgaaagaaggcatatgaagaccaaaaggatattgagcagggttccatacttgaataaaggaagaaactcccttcaatgtttactaagaaatagttagaatatagcatatcctgtatagatgaaatgtcctagcgaaaatgtttaaatgtatttaaagaagagctagattttgtggggggagagaagggaataggataggctggtgggaggaagaatgaaaagaagaaaacttgttggaaattttggagtagattgtgaggaggggtgactcactttaaagatgtatcatttggaggtagacacgattttcagagcacaaaacagataaggaaagatgtatgctgattgtgtggagcccaagggaaggcggggttttggagtcttacgtggctttgtttctgaaagggagacatgtgaagcctactcctgaggcgggaggctggggacatgaccatcaagacctataattgataaacaactaggggctgggtgctgcacttacatgctggggaaatagaaaatgaagcagacatgtgtcccatcttcttccagctttcagtctagcttggaaataaatctcatacctagagaaaatggaggatctgtgggatgtagatgaggtgggagcatgaatgcctagggagggaagaagaaagattttcagttcttcagctcttcctcatgaccctatctcatgccatgagcaattgtctggcatctcctgtgggttggaccactgctgcatttcttacttgccaacatcactttgtcccaaatgccattcctttgttccagggcctccttgtcttccgtctggggaactggaggtgagaagcattataatagcctctctgcctttatctacaatctctccaacctgtgctttatgctgatgtcaggatgggcgttgatggatgcttctatcactgtcggggcagggagggccagaacactagcataagatgtcaatatgtctatccatatgtcaggtccatactcaactcaagcttctggttaactgctgatctattggcaactccagttcccaataagttcctcatctccttctgagaccacctcagtgtggacttaatcgtccacatcactgtcagcattttggttaaaaccattcaacaagtctccaggaagctccaaactttccttcatcttcctgtcttcttctgagccctccaaactcttccaacctctacccgttacccagttccaaaggtgcttccacactttcaagtatctttatagcaatgccccactcctggtaccaaattcctgtattagtctgttttcacactgctatgaagacatacttgagactcggtaatttatatagaaaagaggtttaattgacaaaaaagctaacaaagtgagccctgattcaaaaatgactgtctacacttggcacatgagggactttatgatattaagagattaattaaacaacagtggatggggaggaagaacagacttttgagctcttcccaatataggaatgtgttagttctaaaaattttcttaagttgtttgcttggaactcagagtatatttttccatacgaaaaattcagaactattttatttatgatatgggctaaaaagacttctgtaatctagcttggaaacttaataatcattaaacttattttcaatgagatacgactgtttaaattctgaaacctggaaccctctgttgccctgcaaatgctttaggaaaagaagagtgtgtctgatggaggataagatggaaagtgaatatggatccatattcagaagacacggttgcattacagcaaaggaacagctttttgctggccatgctaagcatttgacattgatgtgggagaacatggcattcagtatgactctgtctggatatatatagttttgtaaattgggtgttcttaagttgagactgcatgtttcattccaaaatcaatcttagttttcccacttgcattagcatattgtattagtccgtcttcacactgctataaagacatacccgagactgggtaatttataaagaaaaga

SEQ ID NO: 436096 - DNA, 1533 bp, Homo sapiens
acgtagcccacctgacgtacccacctggagtgatcacctcttggggaccctgcctatcccacttcacaggtgggaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaaaagtaccacacaaactatgggatccaaggggcagtcttgcaacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattccc

SEQ ID NO: 436097 - DNA, 2515 bp, Homo sapiens
agcactctccagcctctcaccgcaaaattacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgtaaggtcatgctggtgggttagctaaaccaagaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaaaagtaccacacaaactatgggatccaaggggcagtcttgcaacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaacaaccggttggttttattgtctcaggggtgacagaggtggaagaaaatctgtgtataagccaaccgtggactagtgggtac

SEQ ID NO: 436098 - DNA, 794 bp, Homo sapiens
aggatctgttagatcctgcaatcccttcttgcatccatccctccctggtagctaggtcccgatatactcctgtcttgtgagattgtcgagatgagatgggggaccactctttctctgtccttcctctctcctttcctccatagcaaggacgaccttccctgctccatgtccagagtagtttccagagtaggcaaggaagacgttttctttatcgccctgagaagatctaccccagggagaatctgagacatcttgcctacttttctttattagctttctcctcattcatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattccc

SEQ ID NO: 436099 - DNA, 1127 bp, Homo sapiens
agcactctccagcctctcaccgcaaaattacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctgtgagtatctcatgggtagactccagtttacacttttaagtccatcttaccatgggtgtttctggcaacttgaacagattagcacatggttcagtgaaacttccttgtgcaattttctcctctggttatttgttctcttgtggagaaccttggattgctgcttaggttaagaaccctcatctgcttcattgttcaaaaccagtgctcctgggtagctaccaagtggcagtgcatatctgttagtagcacgtgtgtacaagacacttcaagaaggcagaaaggtaggagttctcagaaagatgaaaccactgccacaatgcacatcattattgtgattctcacttaattgttgttctttcccaatatactcggtttggtggaaggacatgctcttttgcatccctgagtagctttcctagacccacaagggccagacaggacagctgggtggtaggcatgaggttctgtgttttacatcacagcgtggccacacaaaccagtgcagacatgagagcccagacacctctaatttatcaacataccgtcgagcttggcccaggggacatccatcagaactcctgtttagggacaaa

SEQ ID NO: 436100 - DNA, 2769 bp, Homo sapiens
aaacacggtgaaaagaaaccgcccattacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgtaaggtcatgctggtgggttagctaaaccaagaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaaaagtaccacacaaactatgggatccaaggggcagtcttgcaacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattccc

SEQ ID NO: 436101 - DNA, 2797 bp, Homo sapiens
agcactctccagcctctcaccgcaaaattacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgtaaggtcatgctggtgggttagctaaaccaagaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaaaagtaccacacaaactatgggatccaaggggcagtcttgcaacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattcccaaaaaaataaagacactaacaaaaag

SEQ ID NO: 436102 - DNA, 2805 bp, Homo sapiens
agcactctccagcctctcaccgcaaaattacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgtaaggtcatgctggtgggttagctaaaccaagaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaaaagtaccacacaaactatgggatccaaggggcagtcttgcaacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcattcatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattcccttcattgtgtgaatgtttttttctaaaaaaaatg

SEQ ID NO: 436103 - DNA, 764 bp, Homo sapiens
agcactctccagcctctcaccgcaaaattacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagctgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattcccttcattgtgtgaatgtttttttctaaaaaaaatg

SEQ ID NO: 436104 - DNA, 314 bp, Homo sapiens
gtctggttggtttccaatacggtagatgcatcagtaggtctttggaaaaactgtaccaacattagctgcagtgacagcctgtcatatgccagtgaaggtatatataaagatattgacccagtgctgacaataggtgtggtcagggaatgttcagcccctggagtgacctcatgcccttgttctcctcgtcctgtgtctacagatgccctcaagacagtgcaggccttcatgattctctctatcatcttctgtgtcattgccctcctggtcttcgtgttccagctcttcaccatggagaagggaaaccggttctt

SEQ ID NO: 436105 - DNA, 4758 bp, Homo sapiens
aaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagccccggcttcgccgccgccgccgccgctgccgccgccccgggcgcgtacatccagatcctcaccacgaacacttccaccacctcctgttcctcctccctccaaagcggcgccgtagccgccggccccctcctccccagtgcccccggcgcggagcagaccgccggcagcctcctctacaccacgccgcacggaccctccagcagagccgggctgctgcagcagccaccagcgctgggacgcggcggcagcggcggcggcggcggccctccggcaaagcgaaggctggagctaggagaaagcggtcatcagtacctctcagatggtttaaaaacccccaagggcaaaggaagagctgcactacgaagtccagatagtccaaaaactccaaaatctccctcagaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgggctgcagtctgtctgaggatgggggcatgctggcccagtgtcaaggcctgtcaaaagaagtgaccgagctcagtcaggaagagaagaaattagatgaactgatccaaagctgcaccctggacctcaaactgttaaccgaggattcagagaatcaaaggttagcttatgttacatatcaagatattcgaaaaattagtggccttaaagaccaaactgttatagttgtgaaagcccctccagaaacaagacttgaagtgcctgactcaatagagagcctacaaatacatttggcaagtacccaagggcccattgaggtttacttatgtccagaagagactgaaacacacagtccaatgaaaacaaacaaccaagaccacaatgggaatatccctaaacccgcttccaaagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggcttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagttaaaaaaaatg

SEQ ID NO: 436106 - DNA, 4545 bp, Homo sapiens
aaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagccccggcttcgccgccgccgccgccgctgccgccgccccgggcgcgtacatccagatcctcaccacgaacacttccaccacctcctgttcctcctccctccaaagcggcgccgtagccgccggccccctcctccccagtgcccccggcgcggagcagaccgccggcagcctcctctacaccacgccgcacggaccctccagcagagccgggctgctgcagcagccaccagcgctgggacgcggcggcagcggcggcggcggcggccctccggcaaagcgaaggctggagctaggagaaagcggtcatcagtacctctcagatggtttaaaaacccccaagggcaaaggaagagctgcactacgaagtccagatagtccaaaaactccaaaatctccctcagaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgggctgcagtctgtctgaggatgggggcatgctggcccagtgtcaaggcctgtcaaaagaagtgaccgagctcagtcaggaagagaagaaattagatgaactgatccaaagctgcaccctggacctcaaactgttaaccgaggattcagagaatcaaaggttagcttatgttacatatcaagatattcgaaaaattagtggccttaaagaccaaactgttatagttgtgaaagcccctccagaaacaagacttgaagtgcctgactcaatagagagcctacaaatacatttggcaagtacccaagggcccattgaggtttacttatgtccagaagagactgaaacacacagtccaatgaaaacaaacaaccaagaccacaatgggaatatccctaaacccgcttccaaagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggcttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcaggctgtgatcttaccacttcaaatgggtgtaatttgaataaattttgtatggtaaaggatcaataaaatgattttttttaagagttaaaaaaaatg

SEQ ID NO: 436107 - DNA, 287 bp, Homo sapiens
ccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgtgagtaggagtcctccccatgccccggctctgagggggtcgtttcaaactgcctggtttcttagttcctcactttcacatccacgcccacacgttcttttcttttctctcctactgttttcttctctctcattctctcttccctc

SEQ ID NO: 436108 - DNA, 869 bp, Homo sapiens
  misc_feature (850)..(850): n is a, c, g, or t
gatatcgtcctgtcttgccgactggcgctggctacatcgtgtcagcccctcgcgtatgattagtcgagtggcagtgcgccggggagagggatgttcgtgtgaagtggctctcggggctgccgtgaggctccgttgacagtctgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggcttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaataatgtttagggcaccatgactgtcaaccgggtggagtgggtcctttgtcggagtggctagcacatcgttatagtgaatgactcacccattatttacattggcaaattcttttggaccgccaaattagcctggataaaggtggggagacgggggcgaaaagggcgaaggaaaagtagtgaaaaagtgacaaaaaatataaagnataacaatccttataaatc

SEQ ID NO: 436109 - DNA, 922 bp, Homo sapiens
gtcccccccgcgcgtgggttataaaaccaggagctccttttgtgtgccccctcctgattgtctccgtggaggcccccctctccccccgctgttttgtgcgcgcccccctatagtgatacctccctgggggtctgttctactctcccccggagtttttcctcatgtgcccccgcggtgcgggtgtaacaccctttttctcccccgggtgcccttctttgttccccctgggcgcctcttttttggggcccccctttatagacaccctttttccccacaaaacgcgcgcgcgcgggtccgcgctctctgccggagatttccccgcgggagatatttgcgctcccccccgcgcgctctccgcgcgcgagcgcgcggcgggggcgcgagcgcgcgcgcggggcccccccctctcttttttttttttttttttttttttttttttcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagttaaaaaaaatg

SEQ ID NO: 436110 - DNA, 1327 bp, Homo sapiens
agcgggttcgcgcgacgaccgcggggtcggcgggcggggcgaggccctggacggcggcggcagtggggctcctccttctgtttcccagactgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacaggtgagtgcatcttctaccatctgggtataaaggagcagaagtggggattagtgcaaatgaccaagactttcagtccacgtcagtgccatgaagggatccaacaaccctttaagttactcatcaggggatatttgtcctcaaacattgtgaaaccaggaactgttcttccctgatcccatgttcacttgattgacatctagtctgtcaatagcttctccaataattgtgaccccactactttgaaagagagggtgttcacctcagcgtaatctgtacaaatgtgactcacttcacataatttttgctttaaaaaatctttagggctgggtgcagtggctcacacctgtaatcccgacacttcaggatgccaaggtgggtagattgcttaagcccaggagctcgagaccagcctgggcaacatagtgggaacccagtctttacaaaaattacccaggcattgtggtgcacacctgtagtcccagctcctcaggaggctgaggtaagaggatctcatgaggcctggagatcaaggctgcagtgagctgtaatggtgcactccaacctgggctacagagggaggccctgtctcaagaaaaaaaaaaaaaaagtctttatgtctaaatttgtcatatctaatccaattcgcccattgatttttatttgaaaattataaggctgggctcagtggcttatctgtaaaatcccatgctttcagaggctaaggtaggaggattgtttgagaccagcctagacaacatagcaaagacccgtctctataaaaact

SEQ ID NO: 436111 - DNA, 354 bp, Homo sapiens
ctgaagttcattcaagccaagaaagataattttaaaaaagaagaaactaaaagttcaaggaagatttcttgtggcaaatgtgcattatttaacatttcttttttttttttttgcgtatttgtttcaagtgcaaagatagtgtagaaataaatttcagaaagaaacgaaattacccataattccatttatgtaacgtaacaatttgtatttttatactttgtccacagactgtgtagttttgcattattgcagttccacttctgtattgtcacttgtgtgactctgtctttcctgagcttgtgcaccaggagttaggtgacccttaatttgagggtgtttgatctcccaagtact

SEQ ID NO: 436112 - DNA, 4265 bp, Homo sapiens
agcgggttcgcgcgacgaccgcggggtcggcgggcggggcgaggccctggacggcggcggcagtggggctcctccttctgtttcccagactgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccttaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgatgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcgggaggctgaggcaggagaatggcatgaacctgggaggcagagcttgcagtgagccgagacagcgccattgcactccagcctgggcaacagagcaagactccgtctcaaaaaaaaaaaaacaaaaaaaatagtgcactctctggccggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaaatttct

SEQ ID NO: 436113 - DNA, 4071 bp, Homo sapiens
actcgatggtggtaacaatctgttaactatgtaaaggtatgtgcatctggagtacttgaagagggcagtttaccccagaaatcttccttagctattagtctgcttcgttgattttttttttcttacgcctagctcacggggaaacgccagattattttctgtccaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccttaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgatgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcgggaggctgaggcaggagaatggcatgaacctgggaggcagagcttgcagtgagccgagacagcgccattgcactccagcctgggcaacagagcaagactccgtctcaaaaaaaaaaaaacaaaaaaaatagtgcactctctggccggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaaatttct

SEQ ID NO: 436114 - DNA, 1545 bp, Homo sapiens
agcgggttcgcgcgacgaccgcggggtcggcgggcggggcgaggccctggacggcggcggcagtggggctcctccttctgtttcccagactgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagcctggaggagactccatctcaaaaaaa

SEQ ID NO: 436115 - DNA, 3735 bp, Homo sapiens
cacgaggccagtacttccctttacagtctgcagcctataaacagtggtgtctaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccttaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgatgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcgggaggctgaggcaggagaatggcatgaacctgggaggcagagcttgcagtgagccgagacagcgccattgcactccagcctgggcaacagagcaagactccgtctcaaaaaaaaaaaaacaaaaaaaatagtgcactctctggccggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaaatttct

SEQ ID NO: 436116 - DNA, 133 bp, Homo sapiens
tgactgccctgggggagagtcacagaaagctataatgccactgcctctcggtttccccaggagctcgcccgtcagcgaggagtcctggagcgcacagagaagatggtggacaagatggaccaagatttgaaga

SEQ ID NO: 436117 - DNA, 4251 bp, Homo sapiens
agcgggttcgcgcgacgaccgcggggtcggcgggcggggcgaggccctggacggcggcggcagtggggctcctccttctgtttcccagactgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccttaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgatgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcgggaggctgaggcaggagaatggcatgaacctgggaggcagagcttgcagtgagccgagacagcgccattgcactccagcctgggcaacagagcaagactccgtctcaaaaaaaaaaaaacaaaaaaaatagtgcactctctggccggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaaatttct

SEQ ID NO: 436118 - DNA, 3855 bp, Homo sapiens
tgcggttgtgtttcttttagaatcaccgtatattacagggcatgtgcgtctttcaactgcggttgggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccttaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgatgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcgggaggctgaggcaggagaatggcatgaacctgggaggcagagcttgcagtgagccgagacagcgccattgcactccagcctgggcaacagagcaagactccgtctcaaaaaaaaaaaaacaaaaaaaatagtgcactctctggccggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaaatttct

SEQ ID NO: 436119 - DNA, 1309 bp, Homo sapiens
agcgggttcgcgcgacgaccgcggggtcggcgggcggggcgaggccctggacggcggcggcagtggggctcctccttctgtttcccagactgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcaaaaaaaaaaatattaataattttttatataaataaaacctcgggggggggcccgggtccccatttggcc

SEQ ID NO: 436120 - DNA, 781 bp, Homo sapiens
agcgggttcgcgcgacgaccgcggggtcggcgggcggggcgaggccctggacggcggcggcagtggggctcctccttctgtttcccagactgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatttgaagatcagccagaaacacatcaatagcattaagggcgtgtttgggggg

SEQ ID NO: 436121 - DNA, 1849 bp, Homo sapiens
gaattcgcggccgcgtcgaccgcttctgtggccacggcagatgaaacagaaaggctaaagagggctggagtcaggggacttctcttccaccagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagcaaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccagtttgggtccctgaacttaacagaattatttagttgctgcttagacagaaatgacttttttccttagattttccc

SEQ ID NO: 436122 - DNA, 420 bp, Homo sapiens
ttttttctagattttcttttttattcttcaaggatcttaatgacagtcacttcctcaccttacattactaatctttaaattaacatagcaccagctttccttagggctgacaaagacaaattgttcattttctgagaaatcgcttgaacccctgaacatctttgctcttcctaggacgaagcaaggttcccctggtgcttatgaccgcagttttcggtggaagtatcaccagttccgtttcctctgccatgtgagttctggtactggggctcccgtggcagttggggttattgagttatttcagtgtgagttcccggcacagcagcaggtatcggaatgtttgtgtcttaggcgggcgcaagacacttgtctaacccggagctggctgtctctaggaagcgagttttcattcctagggca

SEQ ID NO: 436123 - DNA, 351 bp, Homo sapiens
cacaactctcctagagttaaatgttttttttgtttgtttgtttgtttgttttttgagaccatcaacaagatttcaaggctttaaagaaaggagctgcttcaggaagagataaaatgactcgaacgctataaccttcaaatgcagactgggagaagaggtatcagctatgcatgagctggagaggggtgggatagatagagacacaggtgataaagaaaatacagcaaaatgtgaaccctacaatctgggtggtggatgtaaaccctgtagtagcctcacctggggaaagctgccttgcaacaatgaggctgcccattctccaaacccaccccagccaccgagcaggctcca

SEQ ID NO: 436124 - DNA, 4532 bp, Homo sapiens
gaattcgcggccgcgtcgaccgcttctgtggccacggcagatgaaacagaaaggctaaagagggctggagtcaggggacttctcttccaccagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacggaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagcaaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcaacctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgtgaaaaaaatag

SEQ ID NO: 436125 - DNA, 4700 bp, Homo sapiens
cgcgcggtcacgtgacccggcccgagtgcgggcggtggaaggcggaagtaggagaggagttcggcgccgcttctgtggccacggcagatgaaacagaaaggctaaagagggctggagtcaggggacttctcttccaccagatggagtctcactctctcccccaggctggggtgcagcggcgtgatctcagctcactccaacctctgcttcccaggttcaagcgattcttctgcctcagcctccggatacctgggattacagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacggaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagcaaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcaacctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgtgaaaaaaatag

SEQ ID NO: 436126 - DNA, 4050 bp, Homo sapiens
ttagaggatcgttggagaggggttaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacggaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagcaaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcaacctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgtgaaaaaaatag

SEQ ID NO: 436127 - DNA, 4477 bp, Homo sapiens
gaattcgcggccgcgtcgaccgcttctgtggccacggcagatgaaacagaaaggctaaagagggctggagtcaggggacttctcttccaccagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacggaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagcaaatgaagtttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcaacctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgtgaaaaaaatag

SEQ ID NO: 436128 - DNA, 2127 bp, Homo sapiens
cgcgcggtcacgtgacccggcccgagtgcgggcggtggaaggcggaagtaggagaggagttcggcgccgcttctgtggccacggcagatgaaacagaaaggctaaagagggctggagtcaggggacttctcttccaccagatggagtctcactctctcccccaggctggggtgcagcggcgtgatctcagctcactccaacctctgcttcccaggttcaagcgattcttctgcctcagcctccggatacctgggattacagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccagggtaggtcatcaactgagaagacctgagactctggaactgacaccatgagtcacccaatggcttcttgaaacggtccctttctgcggaggtagcatagcacagtgacgtttattccgggtcacttgattgcttttcctatccacttaccttaatattgctcccatgtcttaggacatattagaattattagaagatctctgggaaacaaaaggcgcatgggaggccaagatttagagtgttgatgcattccgccgtaccctatgcccagcctgtccctaaaggcagagtgcttcttattcggcagggcttcgtgagaatgccgccaagttatccaaaaccaaaggatgagagaggcttccaagagagggaagactgtccaagttcaaggagaaggggtttggttccctgtctgccagggacagaaagttctttccacatgtgtctcctggtcccgagagctttcaaaaggggatgtattctgctccaagaaagaatcacctcccagtaaagtagccatgaagggctcctgtataaaatatgcacacttcccctgccctgagtttgtggagggaaaggctgtcggaagtagggactcttaggagagcccgtgtgccctgtttggttcagctgtcaggcgtgtgccacacacatcccacctcatcttctggtcccataattctccatggatgggctgcttttagctccagttttccagtagaatgcttgagttttccttttttccgtacctcctggaggatgaaactcataacctgtcatcatcagtactcactgtgttttccactttgacttgaagtcaaatgaagttaccaaagttaaacatggactt

SEQ ID NO: 436129 - DNA, 2861 bp, Homo sapiens
gaattcgcggccgcgtcgaccgcttctgtggccacggcagatgaaacagaaaggctaaagagggctggagtcaggggacttctcttccaccagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccagggtaggtcatcaactgagaagacctgagactctggaactgacaccatgagtcacccaatggcttcttgaaacggtccctttctgcggaggtagcatagcacagtgacgtttattccgggtcacttgattgcttttcctatccacttaccttaatattgctcccatgtcttaggacatattagaattattagaagatctctgggaaacaaaaggcgcatgggaggccaagatttagagtgttgatgcattccgccgtaccctatgcccagcctgtccctaaaggcagagtgcttcttattcggcagggcttcgtgagaatgccgccaagttatccaaaaccaaaggatgagagaggcttccaagagagggaagactgtccaagttcaaggagaaggggtttggttccctgtctgccagggacagaaagttctttccacatgtgtctcctggtcccgagagctttcaaaaggggatgtattctgctccaagaaagaatcacctcccagtaaagtagccatgaagggctcctgtataaaatatgcacacttcccctgccctgagtttgtggagggaaaggctgtcggaagtagggactcttaggagagcccgtgtgccctgtttggttcagctgtcaggcgtgtgccacacacatcccacctcatcttctggtcccataattctccatggatgggctgcttttagctccagttttccagtagaatgcttgagttttccttttttccgtacctcctggaggatgaaactcataacctgtcatcatcagtactcactgtgttttccactttgacttgaagtcaaatgaagttaccaaagttaaacatggacttctcaaattagaaaaaaacaaacaacaaaaaaacaggttaagtgttttgttatgaaaattatgaaaatgttcttattattatggaaaatttcaaatagatatagagagaataatgttacaaacccccacatactcaacatttagcttcaaaaattatcaactcatggcgggttttgtttcatctgtacaaactagtcggcacactatgatggcctgtggacaaaatccggccctctgactgtttttgtaaataaggttttattggaacacagccacacatatttgttgacttattgtttttggctgtttttgtacttcattggcagagttgagtaattgcagcagactctatggcttgcaaaacctaaaataattactttgtgtagcgctttatagaaaaaatttgctaactcccgatctgtaacccccaacctatccgccgcaccctgatctaggtaattttgaagcaaatcccaaatgtcacatcatctatccatatttcactatgtatttctaaaacatattcttttattcaaaataaaactctaatatcattaacagtattttgtttatattatcaaatacccagtcaatatttgactttctataattgtgtcacaaattaaacattgactttaacagtatgtattacacacttgtactttgtgtactttataacatgtgcactttaaaacagcaggagctctgtgtactgtggcttttttttttttagacggagtctcgctctgttgcccaggctggagtgcagtggtgcaatctccagctcactgcaacctccacctcctgggttcaagcgattctcctgtctcagcctcctaagtagctgggattacaggcgcccgccactatgcccaactaattttttgtatttttagtagagac

SEQ ID NO: 436130 - DNA, 2472 bp, Homo sapiens
gaattcgcggccgcgtcgaccgcttctgtggccacggcagatgaaacagaaaggctaaagagggctggagtcaggggacttctcttccaccagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacggaggagaacaaggaagagtacatcataccatcaacaagatttcaaggctttaaagaaaggagctgcttcaggaagagataaaatgactcgaacgctataaccttcaaatgcagactgggagaagaggtatcagctatgcatgagctggagaggggtgggatagatagagacacagcccagcctgactcctcatacttgttcttgaagtcctccaccagcccctgcatgttgccaagctccgcctccagcttcagcttctcctggcccagagtc

SEQ ID NO: 436131 - DNA, 470 bp, Homo sapiens
gctggctgctgataattggattgcaaaaaggttgagggcatcctggtctcccaacacccccaagtgaagctgtgctggggcacagggtgcctcaggattgctggtggctgctcagtccaatgccatccatgcagggctgggtttttggccatgagataataagtgacctctccgtgctgcagaactgttctcacgacttgggtcatgcttcttgggtgcatgtcctcaaagtccctcatgggctctgcagagacaaagccacactttgaggacccagcctccaaccaccaaggtccagaaggtggggccagcccttcacccttttcttcccgtgtttccaggatgatccaggaaccagctctgcccccaggatgggagatgaaatacaccagcgagggggtgcgatactttgtggaccacaatacccgcaccaccacctttaaggatcctcgcccggggtttgagtcggg

SEQ ID NO: 436132 - DNA, 4526 bp, Homo sapiens
cgcgcggtcacgtgacccggcccgagtgcgggcggtggaaggcggaagtaggagaggagttcggcgccgcttctgtggccacggcagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacggaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagcaaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcaacctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgtgaaaaaaatag

SEQ ID NO: 436133 - DNA, 4057 bp, Homo sapiens
  misc_feature (1)..(1): n is a, c, g, or t
nctataggactcctgtgtgagacggggctctaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacggaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagcaaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcaacctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgtgaaaaaaatag

SEQ ID NO: 436134 - DNA, 3632 bp, Homo sapiens
gccttggccgccttgagccggagctgagcggaggcactgggccgagcctgcttcccgggccttcctaccatgccagggctgctccctgcctccgccaccctggcacaccttcacccgcgtaccgcctcctccccgtcgctctgccttttccaaaactcacttgggccctccgtgcgcagggttcttttttggtttttctgtaaaaatcaaaacaaaaaacagagacttttgagaggagcagatgccacctaaagtcccactgcattccctgcaaagcgctcaaatgtggaagccagtcattggcatttttattttttattgattgattgattttttcaccagtggctttttgtaacctctgtgttctgctgtgtttcttgtgtttagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacggaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagcaaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcaacctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgtgaaaaaaatag

SEQ ID NO: 436135 - DNA, 3399 bp, Homo sapiens
gaattcgcggccgcgtcgaccgcttctgtggccacggcagatgaaacagaaaggctaaagagggctggagtcaggggacttctcttccaccagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacggaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacagggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagcaaatgaagcacaggacatgaaaaccagcagaaaggccctgagctgctgcatagccccatctgatttctgcagttcccgccagcctccaacacggggactctgccgtaactggaatcttcataggtcatattgaaatcttcaagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgtgaaaaaaatag

SEQ ID NO: 436136 - DNA, 2408 bp, Homo sapiens
gaattcgcggccgcgtcgaccgcttctgtggccacggcagatgaaacagaaaggctaaagagggctggagtcaggggacttctcttccaccagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacggaggagaacaaggaagagtacatcatgctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgtgaaaaaaatag

SEQ ID NO: 436137 - DNA, 2519 bp, Homo sapiens
gaattcgcggccgcgtcgaccgcttctgtggccacggcagatgaaacagaaaggctaaagagggctggagtcaggggacttctcttccaccagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacggaggagaacaaggaagagtacatcataccatcaacaagatttcaaggctttaaagaaaggagctgcttcaggaagagataaaatgactcgaacgctataaccttcaaatgcagactgggagaagaggtatcagctatgcatgagctggagaggggtgggatagatagagacacaggtgataaagaaaatacagcaaaatgtgaaccctacaatctgggtggtggatgtaaaccctgtagtagcctcacctggggaaagctgccttgcaacaatgaggctgcccattctccaaacccaccccagccaccgagcaggctcca

SEQ ID NO: 436138 - DNA, 2478 bp, Homo sapiens
gcttctctttaaaattgacccaaggcatgagccactgcgcctggccagcaaatgctttttgtgcagaatacacttctttcaggcattgtcaggtgctgttttgtttaagctctaactcacccctggaatacaggggaatgatgacaaccagcccagccaggcctgactcatcatggtcacatccagcccccacccccggccaactaaccactgcaggctcctcttccagactcaccagggggcctcgaggccccggcatctcccttggccctgggtgtgggttttacaagactgtgtctttcatgacatcatagcccaaccatgtgagaagaaggagaaggcccccctttcttcattaatctgaaaaaaaggaaagtgagaataggctgatttttaaaagttaaggggcaagcagcattgcattctgggggaacgatcctggccacagccgccaaacaaacattcactaggcctcttctgttttcatacccttgtaagtgggttatgtggtgggtatggtcagttttttcttttttcttttcttttcttttttttgagacagagtttcgcttttgttgcccgggctggaatgcaatggcgcgattcagctcactgcaatctccgcctcccgggttcaagtgattctcctgccttagcctcctgaaaagctgggattacagggccctgccaccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattggcgcctagaacagttaggtcgctcgtcacataggcagttaagtggagaaccaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacgcttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgatttaaaagtctggacta

SEQ ID NO: 436139 - DNA, 1722 bp, Homo sapiens
  misc_feature (1274)..(1274): n is a, c, g, or t
tgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatgatacaaagccagcctgcgtatttaacaatgtggaatattatgatggagacatgtttcgaatggacaactgtcggttctgtcgatgccaagggggcgttgccatctgcttcaccgcccagtgtggtgagataaactgcgagaggtactacgtgcccgaaggagagtgctgcccagtgtgtgaagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccngccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggctctgcttcagctgggacaccatcctgtcgggcacttgtctcaccgggggatggtcatcatcatcaaaatgaggagagctgggcacgatgggtcgccggggaatggcagcgggctcaacggacgggaaactgtgttgccctgattaactggccaggggctagcctgggcgcaaccacccatacacctgtgacgtgatcgccacacggcagagcactcgaggcgccaacccagtctaacctcacctggacgcctgaggaacccg

SEQ ID NO: 436140 - DNA, 363 bp, Homo sapiens
cctaggcaggcgccacctaacatgtttctctcagctgcggggtattgaatttgaggctgctctcagcattactgctcatctcaaagaggaacaaatggtcccccaaatggtccagatgcgacagtagggaaaggagtgccaccattcattctgaggtgcctgggccatactctggatgaagctcacagctctaacgtaaggcggctggagtgcaggtgatcatatctacaaaggtgacaagaacatgaacctgcagtcctgttatcagcattttgtctctgtgttccagatttttttttgtaactatgaaatccttgccttgtagtcaacttaaaatgaaataaatccagagtgcaaatgagt

SEQ ID NO: 436141 - DNA, 393 bp, Homo sapiens
ggtgcatattagcttaagaacttttaaacctctgcggcagtaatgagaatctgcatgccaagggcccagcatttctctacaaagcagcccatgagtgcatgtgtgtttgctgtagtgaagggtctatgttagaagctgcggggtattgaatttgaggctgctctcagcattactgctcatctcaaagaggaacaaatggtcccccaaatggtccagatgcgacagtagggaaaggagtgccaccattcattctgaggtgcctgggccatactctggatgaagctcacagctctaacgtaaggcggtctctgtgttccagatttttttttgtaactatgaaatccttgccttgtagtcaacttaaaatgaaataaatccagagtgcaaatgagt

SEQ ID NO: 436142 - DNA, 838 bp, Homo sapiens
tgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagctgcggggtattgaatttgaggctgctctcagcattactgctcatctcaaagaggaacaaatggtcccccaaatggtccagatgcgacagtagggaaaggagtgccaccattcattctgaggtgcctgggccatactctggatgaagctcacagctctaacgtaaggcggtaagtcattttttttttaaacttaaggaagttaatttgaaagtttatgctgatgccatttcatatgacagagactaaagggtatacgtccttgtgttctcttggtggggactgctgtcctaaaggtaaaagattttgatccagaggttggattgttcctcgtgtggcaacagtcctctgacctcagtcattttcaaagtctaatgtctttttggctaacaaaagacatcaagctagagattaaaatttgcagaagatgggagtttttttgttgttttcggtttttttttttttttttttggagacggagtctcactctgtcacccaggctggagtgcaggtgatcatatctacaaaggtgacaagaacatgaacctgcagtcctgttatcagcattttgtctctgtgttccagatttttttttgtaactatgaaatccttgccttgtagtcaacttaaaatgaaataaatccagagtgcaaatgagt

SEQ ID NO: 436143 - DNA, 388 bp, Homo sapiens
ggagacggagtctcactctgtcacccaggctggagtgcaggtgatcatatctacaaaggtgacaagaacatgaacctgcagtcctgttatcagcattttgtaagtgcttcttctcattctaaaaatatgtattgattttaaaaatgaattctgtaacaggatagcaacagtagtaaaaatcctttttatggagaaatttagagctttcagctaacatacacacatactcattcaaatgaaacagcttgtcttgttttaaagaaatatttctgttgtccattgtacaaattttaataacttgtctttcctttttttaggtctctgtgttccagatttttttttgtaactatgaaatccttgccttgtagtcaacttaaaatgaaataaa

SEQ ID NO: 436144 - DNA, 652 bp, Homo sapiens
tgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccacttcctgctgagaggacaaatggagagagttttctgccctgaggcatgacaaga

SEQ ID NO: 436145 - DNA, 884 bp, Homo sapiens
caacaaagaaggaggagaaggaggaagaaggagaagaaaagaaaaaaaaaagtcgtcaaaggatattaattgtcgatagataacagataatgccaaaaaatatagaagcaattcttaaaacacagtgttggaactggtccacagctctgatttttaatgagctcccatttctgaggccaatataaacttcattctatgctgcccatctctgacaggtgggcattaactaccagccccccacggtggtccctgtgggagacctggccaaagtgcagcgggcggtgtgcatgctgagcaacaccacggccatcacggaggcctgggcctgcctggaccataagttcggccaagtgcgccttagtgcactggtacgtgggggagggcatggcagtgggggaattctccgaggcccgcgaggatctggcagctctggaggattatgaagatgtgggcatggattccgtggaagctgaggctgaagaaggcgaagaatagtgaggggagggtgcggcaggcaaccatccctctgtattccccaccataacgctaggagagctaattacctattaaaatttccgtattgcaaattagccgggcgtggtggcgggcgcttgtagtcccagctactgtggagggtgaggcagccgaatggcgtgaacccgggaggcggagtttacagtgagccgagatcgcgccactgcactccagcctgggcgacagagcgagactccggtctcaggaaaataataataaaataaaaaataaaatttctgtattgcgatactgtctttctcctgtgttgtactttgagagattcctcctccagataaccctccctgaagtccaccagttttattgaactacatcagaattttactatttag

SEQ ID NO: 436146 - DNA, 2519 bp, Homo sapiens
caacaaagaaggaggagaaggaggaagaaggagaagaaaagaaaaaaaaaagtcgtcaaaggatattaattgtcgatagataacagataatgccaaaaaatatagaagcaattcttaaaacacagtgttggaactggtccacagctctgatttttaatgagctcccatttctgaggccaatataaacttcattctatgctgcccatctctgacaggtgggcattaactaccagccccccacggtggtccctgtgggagacctggccaaagtgcagcgggcggtgtgcatgctgagcaacaccacggccatcacggaggcctgggcctgcctggaccataagttcggccaagtgcgccttagtgcactggtacgtgggggagggcatggcagtgggggaattctccgaggcccgcgaggatctggcagctctggaggattatgaagatgtgggcatggattccgtggaagctgaggctgaagaaggcgaagaatagtgaggggagggtgcggcaggcaaccatccctctgtattccccaccataacgctaggagagctaattacctattaaaatttccgtattgcaaattagccgggcgtggtggcgggcgcttgtagtcccagctactgtggagggtgaggcagccgaatggcgtgaacccgggaggcggagtttacagtgagccgagatcgcgccactgcactccagcctgggcgacagagcgagactccggtctcaggaaaataataataaaataaaaaataaaatttctgtattgcgatactgtctttctcctgtgttgtactttgagagattcctcctccagataaccctccctgaagtccacctccccagtacgagagtgagtgcgggctctggtttttgtcgggttctttcgtgcaagcgtcccaggccccgttttatttcttccgtcagaggtcattccgaggcgagctgccgcccctgcggctttcgaggctcccaggacactgccgctttccgctcccgggccgctcccgaacgctggggccgctccatcgtgccggggtgtttacggagaaaagtgaggcctgagcggacgaaagagaagcccacgtgggcgacaatactggtagtccagggagctgggacgacgcgggcgcgtcagaaactcgcacgctcgcgccgcttactaacccagctagctaggacctcgccccgccccgccccggtggcgggggcacctccggctctccagtctctatggtaccaacttccggcgcgcgctacccctcgcgagacttcggcggcgcagcaatggccagagcgtgagtgccgctgacagaagtcaagagaatcggctgggacggggttggggcgacaacgggccgggggggacccgacaggccagagccccttggggaggagcggcggctggaggcgcgaggctcctccggatgcccggagagccgcttgcgacttaactcccgcctctttcccagatgccgcgtcactgctccgccgccggctgctgcacacgggacacgcgcgagacgcgcaaccgcggcatctccttccacagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggcccccctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggaa

SEQ ID NO: 436147 - DNA, 2345 bp, Homo sapiens
caacaaagaaggaggagaaggaggaagaaggagaagaaaagaaaaaaaaaagtcgtcaaaggatattaattgtcgatagataacagataatgccaaaaaatatagaagcaattcttaaaacacagtgttggaactggtccacagctctgatttttaatgagctcccatttctgaggccaatataaacttcattctatgctgcccatctctgacaggtgggcattaactaccagccccccacggtggtccctgtgggagacctggccaaagtgcagcgggcggtgtgcatgctgagcaacaccacggccatcacggaggcctgggcctgcctggaccataagttcggccaagtgcgccttagtgcactggtacgtgggggagggcatggcagtgggggaattctccgaggcccgcgaggatctggcagctctggaggattatgaagatgtgggcatggattccgtggaagctgaggctgaagaaggcgaagaatagtgaggggagggtgcggcaggcaaccatccctctgtattccccaccataacgctaggagagctaattacctattaaaatttccgtattgcaaattagccgggcgtggtggcgggcgcttgtagtcccagctactgtggagggtgaggcagccgaatggcgtgaacccgggaggcggagtttacagtgagccgagatcgcgccactgcactccagcctgggcgacagagcgagactccggtctcaggaaaataataataaaataaaaaataaaatttctgtattgcgatactgtctttctcctgtgttgtactttgagagattcctcctccagataaccctccctgaagtccacctccccagtacgagagtgagtgcgggctctggtttttgtcgggttctttcgtgcaagcgtcccaggccccgttttatttcttccgtcagaggtcattccgaggcgagctgccgcccctgcggctttcgaggctcccaggacactgccgctttccgctcccgggccgctcccgaacgctggggccgctccatcgtgccggggtgtttacggagaaaagtgaggcctgagcggacgaaagagaagcccacgtgggcgacaatactggtagtccagggagctgggacgacgcgggcgcgtcagaaactcgcacgctcgcgccgcttactaacccagctagctaggacctcgccccgccccgccccggtggcgggggcacctccggctctccagtctctatggtaccaacttccggcgcgcgctacccctcgcgagacttcggcggcgcagcaatggccagagcatgccgcgtcactgctccgccgccggctgctgcacacgggacacgcgcgagacgcgcaaccgcggcatctccttccacagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggcccccctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggaa

SEQ ID NO: 436148 - DNA, 2987 bp, Homo sapiens
caacaaagaaggaggagaaggaggaagaaggagaagaaaagaaaaaaaaaagtcgtcaaaggatattaattgtcgatagataacagataatgccaaaaaatatagaagcaattcttaaaacacagtgttggaactggtccacagctctgatttttaatgagctcccatttctgaggccaatataaacttcattctatgctgcccatctctgacaggtgggcattaactaccagccccccacggtggtccctgtgggagacctggccaaagtgcagcgggcggtgtgcatgctgagcaacaccacggccatcacggaggcctgggcctgcctggaccataagttcggccaagtgcgccttagtgcactggtacgtgggggagggcatggcagtgggggaattctccgaggcccgcgaggatctggcagctctggaggattatgaagatgtgggcatggattccgtggaagctgaggctgaagaaggcgaagaatagtgaggggagggtgcggcaggcaaccatccctctgtattccccaccataacgctaggagagctaattacctattaaaatttccgtattgcaaattagccgggcgtggtggcgggcgcttgtagtcccagctactgtggagggtgaggcagccgaatggcgtgaacccgggaggcggagtttacagtgagccgagatcgcgccactgcactccagcctgggcgacagagcgagactccggtctcaggaaaataataataaaataaaaaataaaatttctgtattgcgatactgtctttctcctgtgttgtactttgagagattcctcctccagataaccctccctgaagtccacctccccagtacgagagtgagtgcgggctctggtttttgtcgggttctttcgtgcaagcgtcccaggccccgttttatttcttccgtcagaggtcattccgaggcgagctgccgcccctgcggctttcgaggctcccaggacactgccgctttccgctcccgggccgctcccgaacgctggggccgctccatcgtgccggggtgtttacggagaaaagtgaggcctgagcggacgaaagagaagcccacgtgggcgacaatactggtagtccagggagctgggacgacgcgggcgcgtcagaaactcgcacgctcgcgccgcttactaacccagctagctaggacctcgccccgccccgccccggtggcgggggcacctccggctctccagtctctatggtaccaacttccggcgcgcgctacccctcgcgagacttcggcggcgcagcaatggccagagcgtgagtgccgctgacagaagtcaagagaatcggctgggacggggttggggcgacaacgggccgggggggacccgacaggccagagccccttggggaggagcggcggctggaggcgcgaggctcctccggatgcccggagagccgcttgcgacttaactcccgcctctttcccagatgccgcgtcactgctccgccgccggctgctgcacacgggacacgcgcgagacgcgcaaccgcggcatctccttccacagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcaggtgggcctccctgccggccgacgctggggtaggatgtggggctcccggcggactgggacagctgcaggtcatggaagtcccttgagcagcctgcgtccaagggggctgtttcctgttcccagctctgcacagtgaaacccacccccaggatcactgtgcctgtgacacaaggggaaaacaggagcctttccagagagtatctttcagagccccagtcttgccagcaagtccacaaatcaaagaattctttctggctggtcagcccagctcggcttatgcaggctttccacacacctggactgtgaggagtcctgcggggaagcgattggtgtagctgtaacttggcgttccccagacgtattgtttgcacgatgccttccagcatcccacggcgctgctgctgggggcagattggcctggggaggcagcacttgctctccagctcatctgggttgcttttccccgcagtggatatcacaggctaaaggagggggcagtccccaccatatttgagtctttctccaagttgcgccggacaaccaagaccaaaggacacagttacccacctggcccccctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggaa

SEQ ID NO: 436149 - DNA, 2805 bp, Homo sapiens
caacaaagaaggaggagaaggaggaagaaggagaagaaaagaaaaaaaaaagtcgtcaaaggatattaattgtcgatagataacagataatgccaaaaaatatagaagcaattcttaaaacacagtgttggaactggtccacagctctgatttttaatgagctcccatttctgaggccaatataaacttcattctatgctgcccatctctgacaggtgggcattaactaccagccccccacggtggtccctgtgggagacctggccaaagtgcagcgggcggtgtgcatgctgagcaacaccacggccatcacggaggcctgggcctgcctggaccataagttcggccaagtgcgccttagtgcactggtacgtgggggagggcatggcagtgggggaattctccgaggcccgcgaggatctggcagctctggaggattatgaagatgtgggcatggattccgtggaagctgaggctgaagaaggcgaagaatagtgaggggagggtgcggcaggcaaccatccctctgtattccccaccataacgctaggagagctaattacctattaaaatttccgtattgcaaattagccgggcgtggtggcgggcgcttgtagtcccagctactgtggagggtgaggcagccgaatggcgtgaacccgggaggcggagtttacagtgagccgagatcgcgccactgcactccagcctgggcgacagagcgagactccggtctcaggaaaataataataaaataaaaaataaaatttctgtattgcgatactgtctttctcctgtgttgtactttgagagattcctcctccagataaccctccctgaagtccacctccccagtacgagagtgagtgcgggctctggtttttgtcgggttctttcgtgcaagcgtcccaggccccgttttatttcttccgtcagaggtcattccgaggcgagctgccgcccctgcggctttcgaggctcccaggacactgccgctttccgctcccgggccgctcccgaacgctggggccgctccatcgtgccggggtgtttacggagaaaagtgaggcctgagcggacgaaagagaagcccacgtgggcgacaatactggtagtccagggagctgggacgacgcgggcgcgtcagaaactcgcacgctcgcgccgcttactaacccagctagctaggacctcgccccgccccgccccggtggcgggggcacctccggctctccagtctctatggtaccaacttccggcgcgcgctacccctcgcgagacttcggcggcgcagcaatggccagagcgtgagtgccgctgacagaagtcaagagaatcggctgggacggggttggggcgacaacgggccgggggggacccgacaggccagagccccttggggaggagcggcggctggaggcgcgaggctcctccggatgcccggagagccgcttgcgacttaactcccgcctctttcccagatgccgcgtcactgctccgccgccggctgctgcacacgggacacgcgcgagacgcgcaaccgcggcatctccttccacaggtcagcgcgcgtgcgccgcgggctcacgtgcgcatgcgctagttgttgctcgcctcgggtcgcaactgcgtagaggcttcgcgcctttctcagatactgaggaggcttgaacctgtgggtgggaggtgaagcggaacggtcccggcgggactgaatgcagtcgggaaggggaggacgggaagtctagccggcttggacccgccccactctgttacctgccagatgacgctgaggaaactgcttttcttctcgaggcctccgttgcctcgtctgtgcccgggcggtgacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggcccccctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggaa

SEQ ID NO: 436150 - DNA, 2636 bp, Homo sapiens
caacaaagaaggaggagaaggaggaagaaggagaagaaaagaaaaaaaaaagtcgtcaaaggatattaattgtcgatagataacagataatgccaaaaaatatagaagcaattcttaaaacacagtgttggaactggtccacagctctgatttttaatgagctcccatttctgaggccaatataaacttcattctatgctgcccatctctgacaggtgggcattaactaccagccccccacggtggtccctgtgggagacctggccaaagtgcagcgggcggtgtgcatgctgagcaacaccacggccatcacggaggcctgggcctgcctggaccataagttcggccaagtgcgccttagtgcactggtacgtgggggagggcatggcagtgggggaattctccgaggcccgcgaggatctggcagctctggaggattatgaagatgtgggcatggattccgtggaagctgaggctgaagaaggcgaagaatagtgaggggagggtgcggcaggcaaccatccctctgtattccccaccataacgctaggagagctaattacctattaaaatttccgtattgcaaattagccgggcgtggtggcgggcgcttgtagtcccagctactgtggagggtgaggcagccgaatggcgtgaacccgggaggcggagtttacagtgagccgagatcgcgccactgcactccagcctgggcgacagagcgagactccggtctcaggaaaataataataaaataaaaaataaaatttctgtattgcgatactgtctttctcctgtgttgtactttgagagattcctcctccagataaccctccctgaagtccacctccccagtacgagagtgagtgcgggctctggtttttgtcgggttctttcgtgcaagcgtcccaggccccgttttatttcttccgtcagaggtcattccgaggcgagctgccgcccctgcggctttcgaggctcccaggacactgccgctttccgctcccgggccgctcccgaacgctggggccgctccatcgtgccggggtgtttacggagaaaagtgaggcctgagcggacgaaagagaagcccacgtgggcgacaatactggtagtccagggagctgggacgacgcgggcgcgtcagaaactcgcacgctcgcgccgcttactaacccagctagctaggacctcgccccgccccgccccggtggcgggggcacctccggctctccagtctctatggtaccaacttccggcgcgcgctacccctcgcgagacttcggcggcgcagcaatggccagagcgtgagtgccgctgacagaagtcaagagaatcggctgggacggggttggggcgacaacgggccgggggggacccgacaggccagagccccttggggaggagcggcggctggaggcgcgaggctcctccggatgcccggagagccgcttgcgacttaactcccgcctctttcccagatgccgcgtcactgctccgccgccggctgctgcacacgggacacgcgcgagacgcgcaaccgcggcatctccttccacaggtcagcgcgcgtgcgccgcgggctcacgtgcgcatgcgctagttgttgctcgcctcgggtcgcaactgcgtagaggcttcgcgcctttctcagatactgaggaggcttgaacctgtgggtgggaggtgaagcggaacggtcccggcgggactgaatgcagtcgggaaggggaggacgggaagtctagccggcttggacccgccccactctgttacctgccagatgacgctgaggaaactgcttttcttctcgaggcctccgttgcctcgtctgtgcccgggcggtggtgcttacccggcggggtcgcagggaggtctcgtggcggcgcgtgttgggtctgcgtttcccctctggggtgcttgggcagcatgagcccagggctgtggacagcctggtgctcacgggtttgtggctccacagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggcccccctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggaa

SEQ ID NO: 436151 - DNA, 2484 bp, Homo sapiens
caacaaagaaggaggagaaggaggaagaaggagaagaaaagaaaaaaaaaagtcgtcaaaggatattaattgtcgatagataacagataatgccaaaaaatatagaagcaattcttaaaacacagtgttggaactggtccacagctctgatttttaatgagctcccatttctgaggccaatataaacttcattctatgctgcccatctctgacaggtgggcattaactaccagccccccacggtggtccctgtgggagacctggccaaagtgcagcgggcggtgtgcatgctgagcaacaccacggccatcacggaggcctgggcctgcctggaccataagttcggccaagtgcgccttagtgcactggtacgtgggggagggcatggcagtgggggaattctccgaggcccgcgaggatctggcagctctggaggattatgaagatgtgggcatggattccgtggaagctgaggctgaagaaggcgaagaatagtgaggggagggtgcggcaggcaaccatccctctgtattccccaccataacgctaggagagctaattacctattaaaatttccgtattgcaaattagccgggcgtggtggcgggcgcttgtagtcccagctactgtggagggtgaggcagccgaatggcgtgaacccgggaggcggagtttacagtgagccgagatcgcgccactgcactccagcctgggcgacagagcgagactccggtctcaggaaaataataataaaataaaaaataaaatttctgtattgcgatactgtctttctcctgtgttgtactttgagagattcctcctccagataaccctccctgaagtccacctccccagtacgagagtgagtgcgggctctggtttttgtcgggttctttcgtgcaagcgtcccaggccccgttttatttcttccgtcagaggtcattccgaggcgagctgccgcccctgcggctttcgaggctcccaggacactgccgctttccgctcccgggccgctcccgaacgctggggccgctccatcgtgccggggtgtttacggagaaaagtgaggcctgagcggacgaaagagaagcccacgtgggcgacaatactggtagtccagggagctgggacgacgcgggcgcgtcagaaactcgcacgctcgcgccgcttactaacccagctagctaggacctcgccccgccccgccccggtggcgggggcacctccggctctccagtctctatggtaccaacttccggcgcgcgctacccctcgcgagacttcggcggcgcagcaatggccagagcgtgagtgccgctgacagaagtcaagagaatcggctgggacggggttggggcgacaacgggccgggggggacccgacaggccagagccccttggggaggagcggcggctggaggcgcgaggctcctccggatgcccggagagccgcttgcgacttaactcccgcctctttcccagatgccgcgtcactgctccgccgccggctgctgcacacgggacacgcgcgagacgcgcaaccgcggcatctccttccacaggtcagcgcgcgtgcgccgcgggctcacgtgcgcatgcgctagttgttgctcgcctcgggtcgcaactgcgtagaggcttcgcgcctttctcagatactgaggaggcttgaacctgtgggtgggaggtgaagcggaacggtcccggcgggactgaatgcagtcgggaaggggaggacgggaagtctagccggcttggacccgccccactctgttacctgccagatgacgctgaggaaactgcttttcttctcgaggcctccgttgcctcacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggcccccctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggaa

SEQ ID NO: 436152 - DNA, 2208 bp, Homo sapiens
caacaaagaaggaggagaaggaggaagaaggagaagaaaagaaaaaaaaaagtcgtcaaaggatattaattgtcgatagataacagataatgccaaaaaatatagaagcaattcttaaaacacagtgttggaactggtccacagctctgatttttaatgagctcccatttctgaggccaatataaacttcattctatgctgcccatctctgacaggtgggcattaactaccagccccccacggtggtccctgtgggagacctggccaaagtgcagcgggcggtgtgcatgctgagcaacaccacggccatcacggaggcctgggcctgcctggaccataagttcggccaagtgcgccttagtgcactggtacgtgggggagggcatggcagtgggggaattctccgaggcccgcgaggatctggcagctctggaggattatgaagatgtgggcatggattccgtggaagctgaggctgaagaaggcgaagaatagtgaggggagggtgcggcaggcaaccatccctctgtattccccaccataacgctaggagagctaattacctattaaaatttccgtattgcaaattagccgggcgtggtggcgggcgcttgtagtcccagctactgtggagggtgaggcagccgaatggcgtgaacccgggaggcggagtttacagtgagccgagatcgcgccactgcactccagcctgggcgacagagcgagactccggtctcaggaaaataataataaaataaaaaataaaatttctgtattgcgatactgtctttctcctgtgttgtactttgagagattcctcctccagataaccctccctgaagtccacctccccagtacgagagtgagtgcgggctctggtttttgtcgggttctttcgtgcaagcgtcccaggccccgttttatttcttccgtcagaggtcattccgaggcgagctgccgcccctgcggctttcgaggctcccaggacactgccgctttccgctcccgggccgctcccgaacgctggggccgctccatcgtgccggggtgtttacggagaaaagtgaggcctgagcggacgaaagagaagcccacgtgggcgacaatactggtagtccagggagctgggacgacgcgggcgcgtcagaaactcgcacgctcgcgccgcttactaacccagctagctaggacctcgccccgccccgccccggtggcgggggcacctccggctctccagtctctatggtaccaacttccggcgcgcgctacccctcgcgagacttcggcggcgcagcaatggccagagcgtgagtgccgctgacagaagtcaagagaatcggctgggacggggttggggcgacaacgggccgggggggacccgacaggccagagccccttggggaggagcggcggctggaggcgcgaggctcctccggatgcccggagagccgcttgcgacttaactcccgcctctttcccagatgccgcgtcactgctccgccgccggctgctgcacacgggacacgcgcgagacgcgcaaccgcggcatctccttccacaggtcagcgcgcgtgcgccgcgggctcacgtgcgcatgcgctagttgttgctcgcctcgggtcgcaactgcgtagaggcttcgcgcctttctcagatactgaggaggcttgaacctgtgggtgggaggtgaagcggaacggtcccggcgggactgaatgcagtcgggaaggggaggacgggaagtctagccggcttggacccgccccactctgttacctgccagatgacgctgaggaaactgcttttcttctcgaggcctccgttgcctcgtctgtgcccgggcggtggtgcttacccggcggggtcgcagggaggtctcgtggcggcgcgtgttgggtctgcgtttcccctctggggtgcttgggcagcatgagcccagggctgtggacagcctggtgctcacgggtttgtggctccacagacttcccaagaaggacaacccgaggcgaggcttgtggctggccaactgccagcggctggaccccagcggccagggcctgtgggacccggcatccgagtacatctacttctgctccaaacactttgaggaggatgaccgaggggctgcccagcaagactgcagcctcttcctccctcagatcccaccagacccaccaggtgccataataaagcggattctagacggaa

SEQ ID NO: 436153 - DNA, 3407 bp, Homo sapiens
caacaaagaaggaggagaaggaggaagaaggagaagaaaagaaaaaaaaaagtcgtcaaaggatattaattgtcgatagataacagataatgccaaaaaatatagaagcaattcttaaaacacagtgttggaactggtccacagctctgatttttaatgagctcccatttctgaggccaatataaacttcattctatgctgcccatctctgacaggtgggcattaactaccagccccccacggtggtccctgtgggagacctggccaaagtgcagcgggcggtgtgcatgctgagcaacaccacggccatcacggaggcctgggcctgcctggaccataagttcggccaagtgcgccttagtgcactggtacgtgggggagggcatggcagtgggggaattctccgaggcccgcgaggatctggcagctctggaggattatgaagatgtgggcatggattccgtggaagctgaggctgaagaaggcgaagaatagtgaggggagggtgcggcaggcaaccatccctctgtattccccaccataacgctaggagagctaattacctattaaaatttccgtattgcaaattagccgggcgtggtggcgggcgcttgtagtcccagctactgtggagggtgaggcagccgaatggcgtgaacccgggaggcggagtttacagtgagccgagatcgcgccactgcactccagcctgggcgacagagcgagactccggtctcaggaaaataataataaaataaaaaataaaatttctgtattgcgatactgtctttctcctgtgttgtactttgagagattcctcctccagataaccctccctgaagtccacctccccagtacgagagtgagtgcgggctctggtttttgtcgggttctttcgtgcaagcgtcccaggccccgttttatttcttccgtcagaggtcattccgaggcgagctgccgcccctgcggctttcgaggctcccaggacactgccgctttccgctcccgggccgctcccgaacgctggggccgctccatcgtgccggggtgtttacggagaaaagtgaggcctgagcggacgaaagagaagcccacgtgggcgacaatactggtagtccagggagctgggacgacgcgggcgcgtcagaaactcgcacgctcgcgccgcttactaacccagctagctaggacctcgccccgccccgccccggtggcgggggcacctccggctctccagtctctatggtaccaacttccggcgcgcgctacccctcgcgagacttcggcggcgcagcaatggccagagcgtgagtgccgctgacagaagtcaagagaatcggctgggacggggttggggcgacaacgggccgggggggacccgacaggccagagccccttggggaggagcggcggctggaggcgcgaggctcctccggatgcccggagagccgcttgcgacttaactcccgcctctttcccagatgccgcgtcactgctccgccgccggctgctgcacacgggacacgcgcgagacgcgcaaccgcggcatctccttccacaggtcagcgcgcgtgcgccgcgggctcacgtgcgcatgcgctagttgttgctcgcctcgggtcgcaactgcgtagaggcttcgcgcctttctcagatactgaggaggcttgaacctgtgggtgggaggtgaagcggaacggtcccggcgggactgaatgcagtcgggaaggggaggacgggaagtctagccggcttggacccgccccactctgttacctgccagatgacgctgaggaaactgcttttcttctcgaggcctccgttgcctcgtctgtgcccgggcggtggtgcttacccggcggggtcgcagggaggtctcgtggcggcgcgtgttgggtctgcgtttcccctctggggtgcttgggcagcatgagcccagggctgtggacagcctggtgctcacgggtttgtggctccacagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcaggtgggcctccctgccggccgacgctggggtaggatgtggggctcccggcggactgggacagctgcaggtcatggaagtcccttgagcagcctgcgtccaagggggctgtttcctgttcccagctctgcacagtgaaacccacccccaggatcactgtgcctgtgacacaaggggaaaacaggagcctttccagagagtatctttcagagccccagtcttgccagcaagtccacaaatcaaagaattctttctggctggtcagcccagctcggcttatgcaggctttccacacacctggactgtgaggagtcctgcggggaagcgattggtgtagctgtaacttggcgttccccagacgtattgtttgcacgatgccttccagcatcccacggcgctgctgctgggggcagattggcctggggaggcagcacttgctctccagctcatctgggttgcttttccccgcagtggatatcacaggctaaaggagggggcagtccccaccatatttgagtctttctccaagttgcgccggacaaccaagaccaaaggacacagttacccacctggcccccctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggaa

SEQ ID NO: 436154 - DNA, 2939 bp, Homo sapiens
caacaaagaaggaggagaaggaggaagaaggagaagaaaagaaaaaaaaaagtcgtcaaaggatattaattgtcgatagataacagataatgccaaaaaatatagaagcaattcttaaaacacagtgttggaactggtccacagctctgatttttaatgagctcccatttctgaggccaatataaacttcattctatgctgcccatctctgacaggtgggcattaactaccagccccccacggtggtccctgtgggagacctggccaaagtgcagcgggcggtgtgcatgctgagcaacaccacggccatcacggaggcctgggcctgcctggaccataagttcggccaagtgcgccttagtgcactggtacgtgggggagggcatggcagtgggggaattctccgaggcccgcgaggatctggcagctctggaggattatgaagatgtgggcatggattccgtggaagctgaggctgaagaaggcgaagaatagtgaggggagggtgcggcaggcaaccatccctctgtattccccaccataacgctaggagagctaattacctattaaaatttccgtattgcaaattagccgggcgtggtggcgggcgcttgtagtcccagctactgtggagggtgaggcagccgaatggcgtgaacccgggaggcggagtttacagtgagccgagatcgcgccactgcactccagcctgggcgacagagcgagactccggtctcaggaaaataataataaaataaaaaataaaatttctgtattgcgatactgtctttctcctgtgttgtactttgagagattcctcctccagataaccctccctgaagtccacctccccagtacgagagtgagtgcgggctctggtttttgtcgggttctttcgtgcaagcgtcccaggccccgttttatttcttccgtcagaggtcattccgaggcgagctgccgcccctgcggctttcgaggctcccaggacactgccgctttccgctcccgggccgctcccgaacgctggggccgctccatcgtgccggggtgtttacggagaaaagtgaggcctgagcggacgaaagagaagcccacgtgggcgacaatactggtagtccagggagctgggacgacgcgggcgcgtcagaaactcgcacgctcgcgccgcttactaacccagctagctaggacctcgccccgccccgccccggtggcgggggcacctccggctctccagtctctatggtaccaacttccggcgcgcgctacccctcgcgagacttcggcggcgcagcaatggccagagcgtgagtgccgctgacagaagtcaagagaatcggctgggacggggttggggcgacaacgggccgggggggacccgacaggccagagccccttggggaggagcggcggctggaggcgcgaggctcctccggatgcccggagagccgcttgcgacttaactcccgcctctttcccagatgccgcgtcactgctccgccgccggctgctgcacacgggacacgcgcgagacgcgcaaccgcggcatctccttccacaggtcagcgcgcgtgcgccgcgggctcacgtgcgcatgcgctagttgttgctcgcctcgggtcgcaactgcgtagaggcttcgcgcctttctcagatactgaggaggcttgaacctgtgggtgggaggtgaagcggaacggtcccggcgggactgaatgcagtcgggaaggggaggacgggaagtctagccggcttggacccgccccactctgttacctgccagatgacgctgaggaaactgcttttcttctcgaggcctccgttgcctcgtctgtgcccgggcggtggtgcttacccggcggggtcgcagggaggtctcgtggcggcgcgtgttgggtctgcgtttcccctctggggtgcttgggcagcatgagcccagggctgtggacagcctggtgctcacgggtttgtggctccacagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggcccccctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggaa

SEQ ID NO: 436155 - DNA, 2828 bp, Homo sapiens
caacaaagaaggaggagaaggaggaagaaggagaagaaaagaaaaaaaaaagtcgtcaaaggatattaattgtcgatagataacagataatgccaaaaaatatagaagcaattcttaaaacacagtgttggaactggtccacagctctgatttttaatgagctcccatttctgaggccaatataaacttcattctatgctgcccatctctgacaggtgggcattaactaccagccccccacggtggtccctgtgggagacctggccaaagtgcagcgggcggtgtgcatgctgagcaacaccacggccatcacggaggcctgggcctgcctggaccataagttcggccaagtgcgccttagtgcactggtacgtgggggagggcatggcagtgggggaattctccgaggcccgcgaggatctggcagctctggaggattatgaagatgtgggcatggattccgtggaagctgaggctgaagaaggcgaagaatagtgaggggagggtgcggcaggcaaccatccctctgtattccccaccataacgctaggagagctaattacctattaaaatttccgtattgcaaattagccgggcgtggtggcgggcgcttgtagtcccagctactgtggagggtgaggcagccgaatggcgtgaacccgggaggcggagtttacagtgagccgagatcgcgccactgcactccagcctgggcgacagagcgagactccggtctcaggaaaataataataaaataaaaaataaaatttctgtattgcgatactgtctttctcctgtgttgtactttgagagattcctcctccagataaccctccctgaagtccacctccccagtacgagagtgagtgcgggctctggtttttgtcgggttctttcgtgcaagcgtcccaggccccgttttatttcttccgtcagaggtcattccgaggcgagctgccgcccctgcggctttcgaggctcccaggacactgccgctttccgctcccgggccgctcccgaacgctggggccgctccatcgtgccggggtgtttacggagaaaagtgaggcctgagcggacgaaagagaagcccacgtgggcgacaatactggtagtccagggagctgggacgacgcgggcgcgtcagaaactcgcacgctcgcgccgcttactaacccagctagctaggacctcgccccgccccgccccggtggcgggggcacctccggctctccagtctctatggtaccaacttccggcgcgcgctacccctcgcgagacttcggcggcgcagcaatggccagagcgtgagtgccgctgacagaagtcaagagaatcggctgggacggggttggggcgacaacgggccgggggggacccgacaggccagagccccttggggaggagcggcggctggaggcgcgaggctcctccggatgcccggagagccgcttgcgacttaactcccgcctctttcccagatgccgcgtcactgctccgccgccggctgctgcacacgggacacgcgcgagacgcgcaaccgcggcatctccttccacaggtcagcgcgcgtgcgccgcgggctcacgtgcgcatgcgctagttgttgctcgcctcgggtcgcaactgcgtagaggcttcgcgcctttctcagatactgaggaggcttgaacctgtgggtgggaggtgaagcggaacggtcccggcgggactgaatgcagtcgggaaggggaggacgggaagtctagccggcttggacccgccccactctgttacctgccagatgacgctgaggaaactgcttttcttctcgaggcctccgttgcctcgtctgtgcccgggcggtggtgcttacccggcggggtcgcagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggcccccctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggaa

SEQ ID NO: 436156 - DNA, 625 bp, Homo sapiens
cgccagctcccagcccgggaggacggcaaagtggcaggtgctgaggcctcttccacaggaaagcaggtgacatcagcaggtggagctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggaa

SEQ ID NO: 436157 - DNA, 3115 bp, Homo sapiens
gctacggcgagagcatagtagcgaactcggagatttgtcttagccggtcaaccggaagccagtgttccctgggtcccggaggtcggtacggaatcatcgggcgggtacatgccaagtactcaggtggacctctgtatgcacagtcactgaatataggacgcgagagtcaagagcgtaggacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccagcaaaaaaaaaaat

SEQ ID NO: 436158 - DNA, 3033 bp, Homo sapiens
accaacggccgacccggcgcgcgggcagccgggcgggggccgggctggagcggcggcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccagcaaaaaaaaaaat

SEQ ID NO: 436159 - DNA, 2721 bp, Homo sapiens
tgctgagggtagctgggggcgagagcgaggctacggagcaggcgagaggcgacggcgagagctagagcgggcgcagcgttagggtggccgtgcaaggggagccgtggcccgggcccggggcgtgcgagacggcggaagcagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgggagagtccgtctctcaccttgagcccgagacatacacacatagcctggcgacactgaagcgagctcttgctgcgatgaa

SEQ ID NO: 436160 - DNA, 2239 bp, Homo sapiens
tgctgagggtagctgggggcgagagcgaggctacggagcaggcgagaggcgacggcgagagctagagcgggcgcagcgttagggtggccgtgcaaggggagccgtggcccgggcccggggcgtgcgagacggcggaagcagcccagggccttgctgccgccatgactgaggaatcagaggagacagtcctgtacattgagcaccgctatgtctgctctgagtgcaaccagctgtatggatcactggaagagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccagcaaaaaaaaaaat

SEQ ID NO: 436161 - DNA, 3118 bp, Homo sapiens
tgctgagggtagctgggggcgagagcgaggctacggagcaggcgagaggcgacggcgagagctagagcgggcgcagcgttagggtggccgtgcaaggggagccgtggcccgggcccggggcgtgcgagacggcggaagcagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccagcaaaaaaaaaaat

SEQ ID NO: 436162 - DNA, 3382 bp, Homo sapiens
cagcctccaagctcagaggcagagagagggaggaggacaggtgagcggaggcacagaatagaaagagaaatggaaagagacctgccgagggagacttggaaagagggaagccagggtggaggagttctgacagagagagggatctaaacagagacatgccgagagcaacctgggctaacagcaaagagagaagttgggcagagtcagagaggggcccaagagacacaggaaatgggggctcaaaagcggaaagacatatccaggagatagagactggacggggtggggacagggccaaggcccaccgcaggcagaggatgaggctcagaggaacagaaagagccagtctgggaccaggacggaggcttggagacagcaggggcacggacatgccaggggcccgggcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccagcaaaaaaaaaaat

SEQ ID NO: 436163 - DNA, 2299 bp, Homo sapiens
tgctgagggtagctgggggcgagagcgaggctacggagcaggcgagaggcgacggcgagagctagagcgggcgcagcgttagggtggccgtgcaaggggagccgtggcccgggcccggggcgtgcgagacggcggaagcagcccagggccttgctgccgccatgactgaggaatcagaggagacagtcctgtacattgagcaccgctatgtctgctctgagtgcaaccagctgtatggatcactggaagaggtgcttatgcaccaaaactcccacgtgccccagcagcactttgagctggtgggcgtggctgatcccggagtcactgtggccacagacacagcttcaggcacgggcctctatcagacccttgtgcaggagagccagtaccagtgcctggagtgtggtcaactgctgatgtcacccagccagctcctggagcaccaggagctgcacctgaagatgatggcaccccaggaggcagtgccagctgagccatcacctaaggcaccacccctgagctccagcaccatccactacgagtgtgtggattgcaaggctctctttgccagccaggagctctggctgaaccaccggcagacgcacctccgggccacacccaccaaggctcctgcccctgttgtcctggggtccccagttgttctagggcctcctgtgggccaggcccgagtggctgtggagcactcataccgaaaggcagaagagggtggggaaggggcgactgtcccatctgccgctgccaccaccactgaggtagtgactgaggtggagctgctcctctacaagtgctctgagtgctcccagctcttccagctgccggcggatttcctggagcaccaggccactcacttccctgctcctgtacccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcagcccacgtgccatcctggggtggctaccctcctaatggggtcggagcccgtgtgagcgcgcgcagcccagggttgagggggccgggcaaaatgggcactgcgatgagccaaagggcctggagtggcgcgaaagctggataagccgaccaaccaggatggcacagctcgcgctgaaggaagacccgccgcccggtaaagaggaatcacacaaggcgcagagcaagggacaaccgccggggc

SEQ ID NO: 436164 - DNA, 1196 bp, Homo sapiens
  misc_feature (36)..(36): n is a, c, g, or t
gcaggtacctcgcggttatggtacgaggctgggtgncatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgagttgccagcaaaaaaaaaaat

SEQ ID NO: 436165 - DNA, 5980 bp, Homo sapiens
gtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcagaattgctgagtactcctatggggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgagactgaaaactattcttttgactccaactacgtgaatagccgagcccatttaatcaagagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatgatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaaggaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaagtaaaaaaaaaat

SEQ ID NO: 436166 - DNA, 1795 bp, Homo sapiens
gtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcagtaattgtttaaccatcacttgtctcctcggctgttttataaaaggacaaaacagcaagtgtctgcattgcatctcggtttctcccattagcgaggagcaagacaaaaagacagaggagaaagtgagcctaaggggaaagagaattgctgagtactcctatggggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgagactgaaaactattcttttgactccaactacgtgaatagccgagcccatttaatcaagagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatgatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatgtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaagtaaaaaaaaaat

SEQ ID NO: 436167 - DNA, 6121 bp, Homo sapiens
gtcctaatctacttgtcccctgctctcgatgcccaagagtcaatgggctctgtgaacttgtccttgattttcattattgccctgggctccattgcgggcatcctctttgtaactatgatcttcgtggcaatcaagtgcaagcgagacaacaaagagatccggacctacaactgcagtaattgtttaaccatcacttgtctcctcggctgttttataaaaggacaaaacagcaagtgtctgcattgcatctcggtttctcccattagcgaggagcaagacaaaaagacagaggagaaagtgagcctaaggggaaagagaattgctgagtactcctatggggcatcaaaagaaatcaagcaagaagaaaaaaatcagtaagaatgacatccgcctggtaccccgggatgtggaggagacagacaagatgaacgttgtcagttgctcttccctgacctcctccctcaactattttgactaccaccagcagacgctgcccctgggctgccgccgctctgagagcactttcctgaatgtggagaaccagaatacccgcaacaccagtgctaaccacatctaccatcactctttcaacagccaggggccccagcagcctgacctgattatcaacggtgtgcctctgcctgagactgaaaactattcttttgactccaactacgtgaatagccgagcccatttaatcaagagcagctccaccttcaaggacttagagggcaacagcctgaaggatagtggacatgaggagagtgaccaaactgacagtgagcatgatgtccagcggagcctgtattgtgatactgctgtcaacgatgtgctgaacaccagtgtgacctccatgggatctcagatgcctgatcatgatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggttggttcttgagtggctatatttcagagcttttcctaaatgtattgtttataggtgattatcattctgtgacagtcccttgtttcaacaggcagcaggggtgttcagttggagcaaattagctttggcttgagttgttcatggggccttgatgttggggaaacagagacaaattcagttgtgaaaagtattatgtattaagtgtttgaatttatatatttttctatgtcaaaattataatataaattaccattgtttgtggaggattacatttaaaaaagcaaaaagtgaaaaaaaaaagctctggacacctttaataagctcgccactgttttttgtagtgtagacaagttaatggtcatttattgtgtactattcattgattcagtgatgtgaaattgagcccccaaaaggttgtttctgaagctcgagtacttcccaatgccgctactttgctgtggacacccctgctttaaaaacccttttgctagctgtgctattgttgtatttgatattgcaaattgctatgtgtgtggtgatggcaaaaggcttttaaaagttggtgttttctttttcttaaaaaaataataaaactacagacaaaaacaaagtgcaaacaactgagacagcaaatgaatgagcaacaccatgcatatagattgagtacttggagaatactcacgttttttaactcatgtagtgattgctcaccactttgcaaagtatttttcctgcctttcagtggtctgcccaggtccatgatagatcattgcagaaagtcatttttggataggctgctatctaatttgcagttgtcagaaatactgtgctgaaagttttatgacatccatcttttaaattttcaggccctgaacaggaaagttgctcctgaagttatgtttccaggcttagaaattccctctctccaatcatctaaaattgaagatgactgaatctattttaagatctaaattagcatctcttcagacacacacttcctgattcagtgtttcccaatcatgattagaattagactgcaaagcacgtcatgggctgggattgagaactccatgttgctctgtatcttaggcttatatacgtagggatagagtaagcagtacaaagtgtatattttggaaaagacaggtaacaggtaacagcatcgctaatccaattactgtgccttctaaacggagacactcagacacttgaactcatctttttatgactaatagttttttgattaaaaatgtgaacaagaaaatactaaaataaaaatcctttcgatttagccaactctttttgctgtaggctaggaatacaccctttttaaattaacacactgtagatcctttttttctgttttaacattcctctaactcccccatttatcttttgtctattaatattcactagccaacatagtatttttgcagcctaagagttcattatttaaaaataaactaaagaaatatgtcacctttgttctgccttggtcttaagagagttgtttctagagaaacaagttttatggttctgttttcatttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaaggaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagctctcttcgttttcttgtgccgctggaattggcttgtgggtcacttgttgtgcaaaagtgaattaatttcaaataggaatcatattgcttttgtgaaacaaagaaaatttaccaccttgtctgatacatagattggaaggcgctcttggtaaagaataacccacaaacacctgatcttgattggaaagcattgtaggtcattagggaaaactgatgatgctgactgttgctccagctgtgttggcaattcaagatgaccttgttactaactgaaagttgctgtcaaccttagcaaacaaaccagctaacaccattacagcactggttaagtagatttttactggcactggctggcgttcagctgaggaaggctaggatacagactttaatgaccaagagccagactagctcgagctagaaatcagcaacaaatacctccttgtgctatttgaatgctaaggtattagttgcaataggcttacgccttcgctcctctagtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaagtaaaaaaaaaat

SEQ ID NO: 436168 - DNA, 2443 bp, Homo sapiens
gaactatttttagtgccagtgtaaaggattaagaataacattcaattagttggctatttcaggctttattgtacatggtaatgtttcagggagtgtgatttggtctagaatatatccagatccttgtaattatgatattgggttatgacaggattctattatttttagctatgaatggtgcttatttttccctatattaggaatgttaatatttggattatcagagtccatgttataaacagaatttacctatgcaagacaaattctaactgtgcaacattttcatgagaattaaaagttgtgtgttaaggggaaaaccctctgaatgtttttatgtgtaagtgcctaaagaaccgtagaaacagtacatcaaaagctcttataaaagaaaaactgattgaacattagccagaaacaaaatatgatttacatttttttttttggttgctgggactgaataccctaaaaactaagagatgtgagtggggaaaatgtctaattgataagaaagttgatttatattatatttacatgcatcttctaagattgcctttacagtagccaatcagaactttaaaaaaaaaaaagctaacaacatagatcctatgtgttgcccttaagactaaaatactttgcacacgtgattgaatggctcacttaagttgttgaatttccttatacatttaaagtgtacttccgttaagaattattccattttaaatgggtaactttcagcttccgaactattttcctaaacattccagttgtgtattataaaagatcaaaatatctctaggtggtagtacaattttcatttataacgtggaaaagttaactgttaggtttaacattagtattagtgtttttgcaattgctcatagaaaagaacactgaataatggttttcatacaatttttgtaaaacattcttctcccagtttgattccaaatgcttttccccaaattgtctaatatatcataagctagtgtttccttgtatttaatttttccttccaacacaatatttaggaaaaatatgaataacattgtgagtagcgggagacaacacgaaaaagaaacctttcattgttgtggaggggtaggtgttatgtgattgatgcccttcctggcgtttgttttatcctgttattttctcaaaaaagagcacggctttttcttaaatacatttaaattcagaattgcttgcaaaagattggcctggatagatagacatcctagatttaagatagtaccatcttaaaagtatgttgaaaggtaaaataaatcatttcaaaatacttaactttcctaataaggatgttaggttttcttctctttcattagctggccataagtcaaggtccttataacactaggaaattacctttttttactttcaaaattgcattatagtgaattactgtttacaaaatacacatactgtgaacagatataagtttctgtcttttataaggtttgtagaatgaatgtttttttaaagtgagtattatatgttaaatattttaagttttttataaatactagtaactgtttactaatttttgtttggtcaaatgcttgtaaatgtagctgaaagaagatagggagaaactgcggatcccaaactgttccctttttcatttcttgaaatgttaccactacagacatttttttaaggtgaataaacagttgtgatgtgctgtacctaaaatcatgtttaatcgtataaggaaacatttcaatacacttatacaggaagaaaactatagatgaagtacatgtgtgtgattcagtctgattcacagaattctgagagtaatatggaataaaacaactccacttagatgataactgaagcatttcctgccttgtgaaaatttggattttaaattgctgttagaatgggaaatttggacactttatatcattgtataatttcagaatttagtttctgtatcttttggaaaacatgattatagcaaaaacatagaaaataatctattactaaaacaccataaatgtaaaactagtatgcttggctgttaactctaaagatgttacttatgtctgtttttaaaacatgcatgtatttaacaattttatcatagtattgtcatggaaaaaataaatatattttcttacatcttacactgacagacttgggcattattgggtttttccccatgttacacacttaggagaagtggctctgctttgttgttgtatttttttgttctatcccgtaagaaatacagtggttgtaaagcaatcacatagcgctatggatgtatttttaacatttgagtacattgctgtgccattggtgtaacatccatctgtccattaagtcattattgtttacctgagaagttagcatcaaaataatcaaatagtgggaatccaacattagcaaataaataataaatactggtctttaaagtaat

SEQ ID NO: 436169 - DNA, 2390 bp, Homo sapiens
gaactatttttagtgccagtgtaaaggattaagaataacattcaattagttggctatttcaggctttattgtacatggtaatgtttcagggagtgtgatttggtctagaatatatccagatccttgtaattatgatattgggttatgacaggattctattatttttagctatgaatggtgcttatttttccctatattaggaatgttaatatttggattatcagagtccatgttataaacagaatttacctatgcaagacaaattctaactgtgcaacattttcatgagaattaaaagttgtgtgttaaggggaaaaccctctgaatgtttttatgtgtaagtgcctaaagaaccgtagaaacagtacatcaaaagctcttataaaagaaaaactgattgaacattagccagaaacaaaatatgatttacatttttttttttggttgctgggactgaataccctaaaaactaagagatgtgagtggggaaaatgtctaattgataagaaagttgatttatattatatttacatgcatcttctaagattgcctttacagtagccaatcagaactttaaaaaaaaaaaagctaacaacatagatcctatgtgttgcccttaagactaaaatactttgcacacgtgattgaatggctcacttaagttgttgaatttccttatacatttaaagtgtacttccgttaagaattattccattttaaatgggtaactttcagcttccgaactattttcctaaacattccagttgtgtattataaaagatcaaaatatctctaggtggtagtacaattttcatttataacgtggaaaagttaactgttaggtttaacattagtattagtgtttttgcaattgctcatagaaaagaacactgaataatggttttcatacaatttttgtaaaacattcttctcccagtttgattccaaatgcttttccccaaattgtctaatatatcataagctagtgtttccttgtatttaatttttccttccaacacaatatttaggaaaaatatgaataacattgtgagtagcgggagacaacacgaaaaagaaacctttcattgttgtggaggggtaggtgttatgtgattgatgcccttcctggcgtttgttttatcctgttattttctcaaaaaagagcacggctttttcttaaatacatttaaattcagaattgcttgcaaaagattggcctggatagatagacatcctagatttaagatagtaccatcttaaaagtatgttgaaaggtaaaataaatcatttctggccataagtcaaggtccttataacactaggaaattacctttttttactttcaaaattgcattatagtgaattactgtttacaaaatacacatactgtgaacagatataagtttctgtcttttataaggtttgtagaatgaatgtttttttaaagtgagtattatatgttaaatattttaagttttttataaatactagtaactgtttactaatttttgtttggtcaaatgcttgtaaatgtagctgaaagaagatagggagaaactgcggatcccaaactgttccctttttcatttcttgaaatgttaccactacagacatttttttaaggtgaataaacagttgtgatgtgctgtacctaaaatcatgtttaatcgtataaggaaacatttcaatacacttatacaggaagaaaactatagatgaagtacatgtgtgtgattcagtctgattcacagaattctgagagtaatatggaataaaacaactccacttagatgataactgaagcatttcctgccttgtgaaaatttggattttaaattgctgttagaatgggaaatttggacactttatatcattgtataatttcagaatttagtttctgtatcttttggaaaacatgattatagcaaaaacatagaaaataatctattactaaaacaccataaatgtaaaactagtatgcttggctgttaactctaaagatgttacttatgtctgtttttaaaacatgcatgtatttaacaattttatcatagtattgtcatggaaaaaataaatatattttcttacatcttacactgacagacttgggcattattgggtttttccccatgttacacacttaggagaagtggctctgctttgttgttgtatttttttgttctatcccgtaagaaatacagtggttgtaaagcaatcacatagcgctatggatgtatttttaacatttgagtacattgctgtgccattggtgtaacatccatctgtccattaagtcattattgtttacctgagaagttagcatcaaaataatcaaatagtgggaatccaacattagcaaataaataataaatactggtctttaaagtaat

SEQ ID NO: 436170 - DNA, 2603 bp, Homo sapiens
gaactatttttagtgccagtgtaaaggattaagaataacattcaattagttggctatttcaggctttattgtacatggtaatgtttcagggagtgtgatttggtctagaatatatccagatccttgtaattatgatattgggttatgacaggattctattatttttagctatgaatggtgcttatttttccctatattaggaatgttaatatttggattatcagagtccatgttataaacagaatttacctatgcaagacaaattctaactgtgcaacattttcatgagaattaaaagttgtgtgttaaggggaaaaccctctgaatgtttttatgtgtaagtgcctaaagaaccgtagaaacagtacatcaaaagctcttataaaagaaaaactgattgaacattagccagaaacaaaatatgatttacatttttttttttggttgctgggactgaataccctaaaaactaagagatgtgagtggggaaaatgtctaattgataagaaagttgatttatattatatttacatgcatcttctaagattgcctttacagtagccaatcagaactttaaaaaaaaaaaagctaacaacatagatcctatgtgttgcccttaagactaaaatactttgcacacgtgattgaatggctcacttaagttgttgaatttccttatacatttaaagtgtacttccgttaagaattattccattttaaatgggtaactttcagcttccgaactattttcctaaacattccagttgtgtattataaaagatcaaaatatctctaggtggtagtacaattttcatttataacgtggaaaagttaactgttaggtttaacattagtattagtgtttttgcaattgctcatagaaaagaacactgaataatggttttcatacaatttttgtaaaacattcttctcccagtttgattccaaatgcttttccccaaattgtctaatatatcataagctagtgtttccttgtatttaatttttccttccaacacaatatttaggaaaaatatgaataacattgtgagtagcgggagacaacacgaaaaagaaacctttcattgttgtggaggggtaggtgttatgtgattgatgcccttcctggcgtttgttttatcctgttattttctcaaaaaagagcacggctttttcttaaatacatttaaattcagaattgcttgcaaaagattggcctggatagatagacatcctagatttaagatagtaccatcttaaaagtatgttgaaaggtaaaataaatcatttcaaaatacttaactttcctaataaggatgttaggttttcttctctttcattagctggccataagtcaaggtccttataacactaggaaattacctttttttactttcaaaattgcattatagtgaattactgtttacaaaatacacatactgtgaacagatataagtttctgtcttttataaggtttgtagaatgaatgtttttttaaagtgagtattatatgttaaatattttaagttttttataaatactagtaactgtttactaatttttgtttggtcaaatgcttgtaaatgtagctgaaagaagatagggagaaactgcggatcccaaactgttccctttttcatttcttgaaatgttaccactacagacatttttttaaggtgaataaacagttgtgatgtgctgtacctaaaatcatgtttaatcgtataaggaaacatttcaatacacttatacaggaagaaaactatagatgaagtacatgtgtgtgattcagtctgattcacagaattctgagagtaatatggaataaaacaactccacttagatgataactgaagcatttcctgccttgtgaaaatttggattttaaattgctgttagaatgggaaatttggacactttatatcattgtataatttcagaatttagtttctgtatcttttggaaaacatgattatagcaaaaacatagaaaataatctattactaaaacaccataaatgtaaaactagtatgcttggctgttaactctaaagatgttacttatgtctgtttttaaaacatgcatgtatttaacaattttatcatagtattgtcatggaaaaaataaatatattttcttacatctaaaaaaaaaaaaaaaaaaaaaaaaaaacaaaaaaaaaaaaagaaaaagaaagaagagaggaagaaaacaaaaagagaaaacaaagaagaggagaaggaaagaaaagaaaagaagagaagaggagagaggggagacgagaaagagggcgaaaggggagggagagaggcacgagcgggcgggggcggcgggagagcccccaccccccacccacagaccggagacgagaaaagagaacccaacaccaaggacaccgccggggaggcacccagcacgactaccagctaagatgaaacaccagacgcgcgtccgactccagcaaccacacgggagcagtctgcgcgaccatgaccaaccaaacaccaaaccaaaggcgaaaaaccctgcagtaggcacagacggccacaccacaaccaacaacacacagcaacccacgcacccaatggcaagcaagagtacac

SEQ ID NO: 436171 - DNA, 744 bp, Homo sapiens
gaagtgtctgagtgctgctgaagaaaagtactctcaaaaagaagataaatatgaggaagaaaactatagatgaagtacatgtgtgtgattcagtctgattcacagaattctgagagtaatatggaataaaacaactccacttagatgataactgaagcatttcctgccttgtgaaaatttggattttaaattgctgttagaatgggaaatttggacactttatatcattgtataatttcagaatttagtttctgtatcttttggaaaacatgattatagcaaaaacatagaaaataatctattactaaaacaccataaatgtaaaactagtatgcttggctgttaactctaaagatgttacttatgtctgtttttaaaacatgcatgtatttaacaattttatcatagtattgtcatggaaaaaataaatatattttcttacatcttacactgacagacttgggcattattgggtttttccccatgttacacacttaggagaagtggctctgctttgttgttgtatttttttgttctatcccgtaagaaatacagtggttgtaaagcaatcacatagcgctatggatgtatttttaacatttgagtacattgctgtgccattggtgtaacatccatctgtccattaagtcattattgtttacctgagaagttagcatcaaaataatcaaatagtgggaatccaacattagcaaataaataataaatactggtctttaaagtaat

SEQ ID NO: 436172 - DNA, 759 bp, Homo sapiens
gccttcagcataaaagctgatccacaaacaagaggagcaccagacctcctcttggcttcgagatggcttcgccacaccaagagcccaaacctggagacctgattgagattttccgccttggctatgagcactgggccctgtatataggagatggctacgtgatccatctggctcctccaagtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtggaaaaggccaaggttgaagtcggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttca

SEQ ID NO: 436173 - DNA, 922 bp, Homo sapiens
gccttcagcataaaagctgatccacaaacaagaggagcaccagacctcctcttggcttcgagatggcttcgccacaccaagagcccaaacctggagacctgattgagattttccgccttggctatgagcactgggccctgtatataggagatggctacgtgatccatctggctcctccaagtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtaaggacctctctggataatccatctccctctgcttggggctggactcacggggctgtgcagccaggcgatcactgtgaatgatgcaaatgcagcctcttagagacctgctggctgagagtcaggacctctgagctccaatgccagatctgcttctaatccacagagggtctttggacagttcccttccccccaggcctctccatgtgcagaggagggggtggatggaggagctctgaggatccttcccctctaaaacctatcctgaaaatggctcctgaagttctgggggtcatcaggagaatctgggccaacccaggacaatgacaggtcctgcaaccccccaaagagtactcaggcaagggacgctcagggtccgtggacctgtgtaagagctcaaggacatttgtgtgtaagatctgggcacagcctccatcccttgccccttcacagtctttcacatttgttgcccc

SEQ ID NO: 436174 - DNA, 484 bp, Homo sapiens
cggcttctctgggagaggattctgagccagccagctgggagagaagagaggagatgccaggccttaggggaggcaggagagaggggagagggagaggagttccaggcccttgggagggagaaagtgccagcctggcttgccgtgaacgctcaacaaaagctgcttgctttgcaggtggaaaaggccaaggttgaagtcggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttca

SEQ ID NO: 436175 - DNA, 524 bp, Homo sapiens
  misc_feature (24)..(24): n is a, c, g, or t
gcccctaccagatccctccttganccagtgatctaaggcccctcttttccctatctgcctaacagtgcctcacaaggcttgggggctggactccctctactccctctggccatagcccctcctggagatggggtcaaggcagcaggactgatcaagtgactactggttagccagaggagctcagctgagatatggcaagtcccgctgtaaacaggtggaaaaggccaaggttgaagtcggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttca

SEQ ID NO: 436176 - DNA, 827 bp, Homo sapiens
gccttcagcataaaagctgatccacaaacaagaggagcaccagacctcctcttggcttcgagatggcttcgccacaccaagagcccaaacctggagacctgattgagattttccgccttggctatgagcactgggccctgtatataggagatggctacgtgatccatctggctcctccaagtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtggaaaaggccaaggttgaagtcggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttcaaaaaacacagttaatcactacctaccaaatgctatccgcagagttggattgtacataggtctttattt

SEQ ID NO: 436177 - DNA, 994 bp, Homo sapiens
  misc_feature (761)..(761): n is a, c, g, or t
  misc_feature (765)..(765): n is a, c, g, or t
  misc_feature (767)..(767): n is a, c, g, or t
  misc_feature (769)..(769): n is a, c, g, or t
  misc_feature (771)..(771): n is a, c, g, or t
  misc_feature (775)..(775): n is a, c, g, or t
gccttcagcataaaagctgatccacaaacaagaggagcaccagacctcctcttggcttcgagatggcttcgccacaccaagagcccaaacctggagacctgattgagattttccgccttggctatgagcactgggccctgtatataggagatggctacgtgatccatctggctcctccaagtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtggaaaaggccaaggttgaagtcggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttcaanacananananaaanaaaaaacacaacaggggagacacgaccaaaagtatcccactcggaggggggcccaagacatgacagcgtcaccagggacgcgtggcaaccgggggggccccatagaagaggagcacggaaatagaaggccgaggccgagggagagaccggtaaaaagaaggcagaaaggggaaaaagagaaagctggaaacaacggcgaaaagacaccggaaaccgggg

SEQ ID NO: 436178 - DNA, 851 bp, Homo sapiens
ggatgcaagtgggtgagcctcacagcagtaccgacgtcagataagccaacaatatgtaaaacaaggatacaggttccttcttcaccatacaattttgctacatcaatgagcctgcctcacagccgtgaagcccacccactctgcctcctcctctgggatggcaattccttgatacttttcgtaattggaaaacccctgcggggggtcctcggggtgcagctgggggtcctgccgggcaagccgcagcagcatccctcgcttcaggtccatcccaaacttggagcacaggtcctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtggaaaaggccaaggttgaagtcggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttca

SEQ ID NO: 436179 - DNA, 609 bp, Homo sapiens
aaaaagtatcatcaaagtgtgaatgtaaagcaaattctgactgtatcataattgtaacgaaactttgctccctgctgtgctggaagatctaatctaagcaaaagtcagactttctaggtttcacgcttgttttcctgtgatagaaacctgctcataacatttagctcaggagaaataaaaaatcatatgcctaaaacatgaacatcactccctgagtgcattccccaagaagcactttataaaatcggataatacaatgttaaggattaggtctttagattgctcaagccaagaccagttcttctgatcagatttttttatcaaaatgctttgtcttcttactaattgtccagcctgagcaagcctctctgtagaattcatctctaatggttgtccattgacacacacaaagtagatactgtcaaactccattagctcagcaaatctctgtttgtagaattcttgagctagaggacctccatcttttgttctgcgccgtatgtggagaaccacagcagaagattgagaaattcagactagtgtttccacattcctaaaagccgtcactgtccgacaaatatatttcggtctttctgcatttagctgccc

SEQ ID NO: 436180 - DNA, 981 bp, Homo sapiens
cggacgcgtgggtcgacccacgcgtcgccacgcgatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgaaaaacacagacaaaaacaaaacaaaacacagacacacacacagaaaaaacacaaagacagcacaagacaaaaaaaaccagaaacaacacgagcacggcacagaaagaacacacccacgaagaaagacgaaagacaggacaacacagccagggagcggagcccgccacacaagcagcggaggagagggagggcgcgggccggcaggcgcggagccgacgggcgtcaacagcagcaggggggcagcgcacgaaacaggagaggggagaggagcggcggaggaagggggcggcacggagaccagacatggaacgcgggaagcaaagagcaaacgagcaggcggaggcaaaccgcgagcaaggggcgaccgcaccgctacccgacgcaggagcgacgcaagacagcgcacggcgcacccaccccccaaggagaccgaacacgaacgacgcaggagagagaccgcacaaacaacgaaaggca

SEQ ID NO: 436181 - DNA, 630 bp, Homo sapiens
  misc_feature (499)..(500): n is a, c, g, or t
  misc_feature (520)..(520): n is a, c, g, or t
  misc_feature (522)..(522): n is a, c, g, or t
  misc_feature (538)..(538): n is a, c, g, or t
  misc_feature (558)..(558): n is a, c, g, or t
  misc_feature (560)..(561): n is a, c, g, or t
  misc_feature (564)..(565): n is a, c, g, or t
  misc_feature (569)..(569): n is a, c, g, or t
  misc_feature (619)..(619): n is a, c, g, or t
cgccgagtgacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatganngttcggtcgtgttctgtgtncnctttttttttttttantttccctttatcctttgtcnanncannttgnttttttttttcctctggatggcctttcgcacggggggggggttgtgcttnttgcgctttgg

SEQ ID NO: 436182 - DNA, 2687 bp, Homo sapiens
cgccgagtgacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagacaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgaaaaacacagacaaaaacaaaacaaaacacagacacacacacagaaaaaacacaaagacagcacaagacaaaaaaaaccagaaacaacacgagcacggcacagaaagaacacacccacgaagaaagacgaaagacaggacaacacagccagggagcggagcccgccacacaagcagcggaggagagggagggcgcgggccggcaggcgcggagccgacgggcgtcaacagcagcaggggggcagcgcacgaaacaggagaggggagaggagcggcggaggaagggggcggcacggagaccagacatggaacgcgggaagcaaagagcaaacgagcaggcggaggcaaaccgcgagcaaggggcgaccgcaccgctacccgacgcaggagcgacgcaagacagcgcacggcgcacccaccccccaaggagaccgaacacgaacgacgcaggagagagaccgcacaaacaacgaaaggca

SEQ ID NO: 436183 - DNA, 3681 bp, Homo sapiens
aagatctagagccaaggtacacaggacctgatctaaaaacaagctgtcctgcagccagctgtgttgactctctaaacctcactttactcatttgtaaaataggagtaatattcccctcagagagttatgagggttaaaggaggaaaagcatggaaagagtctagcgccacggcatggtccttacttatctaccagatactaaactccgtgaggacggtgatgagatctgttgtagccctggtcattgacacatgacagatgtaaagtgactgttcaaacagcccatcagactgttgtataccaaggcacatgctaggtgctatctaggatacagagaagagagtaagaagacccaggaacctgtgatctattcgaggaggcgggactttatacctgaaaaaccaaagtgatactttccaagtaatggagccaataatgacttcagagtcagagtggttaagaaagatctgcatggggagaaataaagcctttgatgaagattttaaaagatgagtaccttcctgggccgggcgcggtggctcatgcctgtaatcccagcactttgggaggccgaggtggacggatcacttgaggtcaggagttcgagaccagcttgaccaacatggtgaaaccccgtctctactaaaaaatacaaaattagccgggcgtggtggcacatgcctgtaatcccagctgcttgggagactgaggcaagagaattgcttggacccaggaagcggaggttacagtgagccgagatcgcgccattgcactccagcccgggcaacaggagcgaaactccgtctctcaaaagagggggaaaaagaaagagtaccttcctaaaagaggaggcatttcttcaacacacctttccactcacaccacccactccctgcatcccagtgttcctgactctgtttctgtaaattaatctatttttccatattggaaaaagggcattctgtaactgtttgtaactatgaaaacagttccttccacaatgaaaagatcaggaaagtactgagtacattcaagcagatgtgtgccttagaacaagtttcaaaaaaggacagtagagcttacctatcgtgggatcagatacttcagggatacaaagtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagacaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgaaaaacacagacaaaaacaaaacaaaacacagacacacacacagaaaaaacacaaagacagcacaagacaaaaaaaaccagaaacaacacgagcacggcacagaaagaacacacccacgaagaaagacgaaagacaggacaacacagccagggagcggagcccgccacacaagcagcggaggagagggagggcgcgggccggcaggcgcggagccgacgggcgtcaacagcagcaggggggcagcgcacgaaacaggagaggggagaggagcggcggaggaagggggcggcacggagaccagacatggaacgcgggaagcaaagagcaaacgagcaggcggaggcaaaccgcgagcaaggggcgaccgcaccgctacccgacgcaggagcgacgcaagacagcgcacggcgcacccaccccccaaggagaccgaacacgaacgacgcaggagagagaccgcacaaacaacgaaaggca

SEQ ID NO: 436184 - DNA, 2900 bp, Homo sapiens
aagatctagagccaaggtacacaggacctgatctaaaaacaagctgtcctgcagccagctgtgttgactctctaaacctcactttactcatttgtaaaataggagtaatattcccctcagagagttatgagggttaaaggaggaaaagcatggaaagagtctagcgccacggcatggtccttacttatctaccagatactaaactccgtgaggacggtgatgagatctgttgtagccctggtcattgacacatgacagatgtaaagtgactgttcaaacagcccatcagactgttgtataccaaggcacatgctaggtgctatctaggatacaggcgtgagccaccgcacctggccctgttcctccattctttgtgcattacttgctgtgatcacactcatctaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagacaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgaaaaacacagacaaaaacaaaacaaaacacagacacacacacagaaaaaacacaaagacagcacaagacaaaaaaaaccagaaacaacacgagcacggcacagaaagaacacacccacgaagaaagacgaaagacaggacaacacagccagggagcggagcccgccacacaagcagcggaggagagggagggcgcgggccggcaggcgcggagccgacgggcgtcaacagcagcaggggggcagcgcacgaaacaggagaggggagaggagcggcggaggaagggggcggcacggagaccagacatggaacgcgggaagcaaagagcaaacgagcaggcggaggcaaaccgcgagcaaggggcgaccgcaccgctacccgacgcaggagcgacgcaagacagcgcacggcgcacccaccccccaaggagaccgaacacgaacgacgcaggagagagaccgcacaaacaacgaaaggca

SEQ ID NO: 436185 - DNA, 2476 bp, Homo sapiens
cgccgagtgacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgagtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagacaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgaaaaacacagacaaaaacaaaacaaaacacagacacacacacagaaaaaacacaaagacagcacaagacaaaaaaaaccagaaacaacacgagcacggcacagaaagaacacacccacgaagaaagacgaaagacaggacaacacagccagggagcggagcccgccacacaagcagcggaggagagggagggcgcgggccggcaggcgcggagccgacgggcgtcaacagcagcaggggggcagcgcacgaaacaggagaggggagaggagcggcggaggaagggggcggcacggagaccagacatggaacgcgggaagcaaagagcaaacgagcaggcggaggcaaaccgcgagcaaggggcgaccgcaccgctacccgacgcaggagcgacgcaagacagcgcacggcgcacccaccccccaaggagaccgaacacgaacgacgcaggagagagaccgcacaaacaacgaaaggca

SEQ ID NO: 436186 - DNA, 1794 bp, Homo sapiens
cggacgcgtgggtcgacccacgcgtcgccacgcgtctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagacaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgaaaaacacagacaaaaacaaaacaaaacacagacacacacacagaaaaaacacaaagacagcacaagacaaaaaaaaccagaaacaacacgagcacggcacagaaagaacacacccacgaagaaagacgaaagacaggacaacacagccagggagcggagcccgccacacaagcagcggaggagagggagggcgcgggccggcaggcgcggagccgacgggcgtcaacagcagcaggggggcagcgcacgaaacaggagaggggagaggagcggcggaggaagggggcggcacggagaccagacatggaacgcgggaagcaaagagcaaacgagcaggcggaggcaaaccgcgagcaaggggcgaccgcaccgctacccgacgcaggagcgacgcaagacagcgcacggcgcacccaccccccaaggagaccgaacacgaacgacgcaggagagagaccgcacaaacaacgaaaggca

SEQ ID NO: 436187 - DNA, 928 bp, Homo sapiens
  misc_feature (13)..(13): n is a, c, g, or t
ccctagaggattnctagggtcttagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgaaaaacacagacaaaaacaaaacaaaacacagacacacacacagaaaaaacacaaagacagcacaagacaaaaaaaaccagaaacaacacgagcacggcacagaaagaacacacccacgaagaaagacgaaagacaggacaacacagccagggagcggagcccgccacacaagcagcggaggagagggagggcgcgggccggcaggcgcggagccgacgggcgtcaacagcagcaggggggcagcgcacgaaacaggagaggggagaggagcggcggaggaagggggcggcacggagaccagacatggaacgcgggaagcaaagagcaaacgagcaggcggaggcaaaccgcgagcaaggggcgaccgcaccgctacccgacgcaggagcgacgcaagacagcgcacggcgcacccaccccccaaggagaccgaacacgaacgacgcaggagagagaccgcacaaacaacgaaaggca

SEQ ID NO: 436188 - DNA, 468 bp, Homo sapiens
tgaaaaaacagttaaagttatgtcagatactgttgttaaataatatagtaatgttttgatctgatggttttgttcatgaacttatacaattttagattttcacagtaagaaacccattgtaattctgtcctgcctggaaattctgtttacttacaaaatcaaattggatttttttttttagccaaaggaattttaaggagagttgtttttttattgaggcaaaattaccataacatacaactaaacattttaaactgtatataattgagtgttatttagtatattgataatattttgcaaccattacctctttccattttcagaactttttcatcaccccagaacacctcatgcccatttagtaatcattcactatttccccttcctcccattctctggttacctctaatcagctctctctttctgtggatttgcctgttctgggtatgtcatataaaaggaatcata

SEQ ID NO: 436189 - DNA, 384 bp, Homo sapiens
atttggaatcgtaatgtactcatgctcatgcctttacatgttccaggtctacaggtccaactgctgccactggcagtaatcgaagacttcagcagacacaaaatcaagtagatgaggtattgctctgaaatgttggaaatatgaattttaaacaaatatgagtactctggaaatctgtttagaaaaagtatcatcaaagtgtgaatgtaaagcaaattctgactgtatcataattgtaacgaaactttgctccctgctgtgctggaagatctaatctaagcaaaagtcagactttctaggtttcacgcttgttttcctgtgatagaaacctgctcataacatttagctcaggagaaataaaaaatcatatgcctaaaacatgaa

SEQ ID NO: 436190 - DNA, 194 bp, Homo sapiens
cactgagagactaacctgctgtttcccctgcctttttgcatctctcctccttcttagtgtgggttgtctcttcatgaagaaccagcggaactcaaaactgctgttcaagaaacctcttcaagacttttgacttagaacctgctatattatcaagcttacctactgttatctctaaaattttttttgtgttaatg

SEQ ID NO: 436191 - DNA, 3475 bp, Homo sapiens
cgccgagtgacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagacaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgaaaaaaaacaaagaaaaaaaaaaaaaaaaaaaaaaacaaaaaaaaaaaaaaaaaaaaaaaaaaacaaaaacaaaaaaaaaaaaaaaaaaaaaacaaaaaacaaaaaagaaaagaaggagaggggaggggagagcaaaaagaaacaaacacagagaagaacagagaaacaagcagacaaacaaaaagaggaagcacagggaagcagaaaaacagcaagcaagaaaaaaaaaagaaagaaagagaggaacgcaaagaaaaaaaaagagagaagaagacgaccagcagaaaacaacaaaacaaacatacacaagaacgacgacaaccagcgaccaaacagacaacagacgcggtcgctaccaagagaaagaccaagagaaaaacgaccaaaagaacgaagaaaacagacaagcacagaagacaacacggacggtcgaagacaaacacacgacagacacgaacaagaggagagagaaggggagcaggggaggcagcacggcgacagagaaccgaacaaaagaaagagcaaagcagagaaagggcgcagcgaggcagcgccagcacacgcgccagcgaacaacagcaccaggagacagaaggggagagagagcaagagaacgagaaggccgcaccaaaacccgaaaccagagagaacagaggagagacagcagacaggacgaaagacagaagaaggcacgagcatagagcaaaccaaaatgcagagcagcaagagagtgagaggacgaagcggactcagtgccagagcacgcagccacgcacgaagaggacacggcacagaaccgaagcaggagcgcggccagcgcgggcccagacgaggggacagaagcggagatggaacaaacacgaccgagcaagcgcgagggaggagaggagagagcagcagggtcagacagagaagacagagggaccgaagaaggagcaggcagaagcacagggacagagggaacggaggcgaacaagagcagagagagaacggcagcggaaaaaagagagacgagacaggacagacgagcacaaaaaaggatagaaacatgcacacgcgaagaggggagcgccacgggaaagcgacgaaagcgacgaagcaaggcaaagacggaggacgcaacagcgagccgccgacgcgaaaggagcgagcggagagacgagacgacgaaaccgcacgagacacgcacactagaggagccagcggcagccagcaggcggataggagaacgagacacagagacgagcggagcacgcgagcacaca

SEQ ID NO: 436192 - DNA, 1354 bp, Homo sapiens
ctacctcaaaccttctctaacccccatgcaaaatactgaatcagaaggggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagacaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgaaaaacacagacaaaaacaaaacaaaacacagacacacacacagaaaaaacacaaagacagcacaagacaaaaaaaaccagaaacaacacgagcacggcacagaaagaacacacccacgaagaaagacgaaagacaggacaacacagccagggagcggagcccgccacacaagcagcggaggagagggagggcgcgggccggcaggcgcggagccgacgggcgtcaacagcagcaggggggcagcgcacgaaacaggagaggggagaggagcggcggaggaagggggcggcacggagaccagacatggaacgcgggaagcaaagagcaaacgagcaggcggaggcaaaccgcgagcaaggggcgaccgcaccgctacccgacgcaggagcgacgcaagacagcgcacggcgcacccaccccccaaggagaccgaacacgaacgacgcaggagagagaccgcacaaacaacgaaaggca

SEQ ID NO: 436193 - DNA, 2267 bp, Homo sapiens
cgccgagtgacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagacaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaatagaggagtcggggggtggggtggggtgggggtggggtgtgggggggtgagtgggggggggggtgtgcggggggttg

SEQ ID NO: 436194 - DNA, 1214 bp, Homo sapiens
cgccgagtgacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtg

SEQ ID NO: 436195 - DNA, 382 bp, Homo sapiens
gagctcggtacccagttcgacggagactctcagtttcttctctataactggtcctgtgaggtcacattacaaaagaagaaactgagggtctctgaggttaagtagctttactaaattataaggaaacctagctggtaggtagacagcaagaatccaggtcttctgactcctctttcagttctctttccacttagaccatagctgcttccttttcttattttttagcttccatctaaccattgcctatcttgcctgtcctaatgttctccatcttctctcacccctaatcccactcactgcttctctaccactttgctttttggtggatgctagcaatgtgctttgagagtctccgtcgaactgggatcctctagatcaacgg

SEQ ID NO: 436196 - DNA, 6102 bp, Homo sapiens
  misc_feature (41)..(41): n is a, c, g, or t
cagggctgacagcacacacggcctgggggcctagagaaggnttgctgatcacctgccacccagggtcggggccccgcaccatccgggggcgagctcccgggaaggggctccgcctctacacccaccccccaacctctgacatcgccggccgaacgggagctgccgcttccttcccggccccgctgcacctccccagggagccgagggcgggcgtggacgggaccgacgtggaacgcattctgtagcccagacgggcggccccggcggcttcgggagtggggtcacgcccagctggagaagcagttagggcggacgaagcaggagccgcggggctgggaggattccagtcggaacgcaaccgatcctggggaggcgagaggtgaatcaacctggacccttccacagcctggctgctaggccagcagtgcgactcccttccgagctgagcttaccctgggcgcaaacgagcgaggcaggggcgcgagtggaagctggagttccggggtgggcggggaggcgactgtccgtggtgctgagcgccggcgagagcgggcgcggagcggctgatcggctccctcgaactggggaggtccagtggggtcgcttagggcccaaagcccccacccggctccaaaagctcccagggcctccccaggcaccggtgctcggcccttccttcggtcagaaagtcgccccctgggggcagttcgtcccaaagggtttcctcgaaagaatctgagagggcgcagtccttgaccgagggaatctctctgtgtagccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtggaatggcagcaaggacctgcaggacgtgtccatcactgtgctcaacgtcactctgaacgactctggcctctacacctgcaatgtgtcccgggagtttgagtttgaggcgcatcggccctttgtgaagacgacgcggctgatccccctaagagtcaccgaggaggctggagaggacttcacctctgtggtctcagaaatcatgatgtacatccttctggtcttcctcaccttgtggctgctcatcgagatgatatattgctacagaaaggtctcaaaagccgaagaggcagcccaagaaaacgcgtctgactaccttgccatcccatctgagaacaaggagaactctgcggtaccagtggaggaatagaacaggagcagtgtgacatgaggtggcctgaacacctgagggactggacatcccatgttcagcaatgtcaatggcatcaggagggcgccccaagggccccatcgcttcccttcatgcatccattgttctgttcattcattcatccatacatccacctgcctctgagctttcacctctgactccctaactccatcagacctctacgcaccataagactctgccagaactgagaagccaacatttctacatagactcaacctcaccctctcctagttttccaacaagacactccaaagccaactggatttctcccctgtgctccaaatgactttgtacaagtgctggagttagcacctccctctgcccttaactggctggaactggttcattctccattactgcaagagaatggaagtcttaatagaaggaagcaggagtgattagttcgggttaaagcaaaagtgtgtcatgaacttggattccctgaagtcagttttgtcaggttcatggcccactttgctacagcatcagagtgaagcacgcctgtctaggttctccagtgacagaaagatcctgaagcatggactaacatgctctctggagcttagtactccagagctagatcctgatgggtctctaaggttccctccaagaagacaaggacaggagacttgggaaggaccaatggtaatttaagtggctcttaaaaagtcatgcaacatgtttctggacacgttcctgatcctattgcgataatgtatgtgtgccctccctgtgggcacaccacctgggcattaggactgaaattcctgagttcttcctctcaaaatttctgtgcaccagtattattcctcattttacatacaggaggcaactaagactcatacagggctcaactgaataagaggcttaagaggataaactggagcagaaataagccttaggtgctgcccagtttacacttcctgggatggatgtttttgtttgttttgttttttgttttttttgtttgagatggagtctcactctgtcacctaggctagagtgcagtggtgtgatctcggctcactgcaacctctgcctcttgggttcaagcaattctcatgcctcggcctctccagtagctgggattacaggtgtgcaccaccacgcctggctaaattttgtatttttagtacagacagggtttgactatgttggccaggctagtcttgaactcctgacctcaaatgacccacccacctcagcctcccaaagtgctgagattacaggcgtgaggcactgcgcccggtggataactttgtttctgaaaagactgacattgaacttgtctatggcaatgcttctttcacaagcacggactgggctgaggtcaactctgatagattcagatgactagaaattggccaaaaaagcagggagaagaacatgaggtagacttaaagaacttcctttatgtaaagatctgtgactctgaaatatcctccaaaaggagagtgcatctgagactgatatttaaactaagaaaaatgtttagtctgagatggatcataagtaaatgagcagtgtgagaggggagggatgggtaggtgctttccaaatacttcgcctatgaatgcataattttcagatttttttcccctagattttgagggagcagagaaactggaaaaaactttagtcaatatctcgtgtttcattttaattaagtgacaggtccaagtgtgacatccttcagcacccagggacaagagaggggaaagatgctttatggaatgtaagaagatgaaggtgactgggattcagcgagagagaggtccctcagacctgggacctccctttatagggaaagaccatattccataggtttagggctttaccttaaaagctcatttttttcattcttccatccctaggaaagtacttaaaaccagacttttaaatttttatttatttattattatttttttgagacagattctcactctgtctcccaggctagagtgcagtggtgcaatctcagctcactgcagcctcaactgccccaggtttaagcaatcctcccacctcagcccccaggtaactgggactacaggcatgcaccaccatgcctggctaatttttgtattttatgtagagacaggggtcttgccatgtcgcccaggctgatcttgaactcctgggctcaagcaatctgccagcctcagcctctcaaagtgctgggattacaggcctgagcaactgtgcctggcccaaaaccagaccgttaacacattaaagagtctgattttgttgaagaaaatatttgcaataaattcaagactcttcttattggtaattttccacacaatccctctgaaataagggagaggatatagacctttttaactttatagttagaaaaattggcctcagtgtgaaatttttccagtcccatagctcatggatgccaccagcttgcggtagtagcaagatgcttactaccacaccgttttcctcggtggcccaatagctcgtgtatctaagttgaacccggcagtatgcatgattgcctttttctcttctttttaaaaaaacccaactcagatgctgcttgcgtggcttttaatgaagctgaatggtatctatcacttatttatccttgacaggttatcttccccactcttcctttttctaacttctccattcttctcattcttgacactttcattagaactatatggtttacgaagtattttcacttaactattttatttcttctctataactggtcctgtgaggtcacattacaaaagaagaaactgagggtctctgaggttaagtagctttactaaattataaggaaacctagctggtaggtagacagcaagaatccaggtcttctgactcctctttcagttctctttccacttagaccatagctgcttccttttcttattttttagcttccatctaaccattgcctatcttgcctgtcctaatgttctccatcttctctcacccctaatcccactcactgcttctctaccactttgctttttggtggatgctagcaatgtgctttgagagtcagtcctattttggttctctttctagttggtttgtacatcattatttctcctgaattgcaattaaactccttcctgggagatttgataatgactgtaaatcaataaggtactgtgatcaccagcctacttccaatctccacccacctccctgtctcttcccataatcctacgaaagacccagactagatgtctgtttctctggaagctttatctggcatgatgttgcttattaaagggcttagaagagttctcaagggctattaatatcactttagaaaccccatctgttgtcttggtgctggatatttcccatgtctgatcctcaataacacaattcactaaaggccaagcttggctcaatctgattttcccattcttactacttcacagccatgaatgtgattgctcaatccagttggccctgagagcaccttgccctgctgaccttcactgtcacctcggtcttgaatcagagccccaacccaaacactccctgcctgtccctaccccagcctttattctcaccacttgtttaacggcatgaccttttagtttctccattcccagacacccacacacccagacttccttctgagttgcaggtttctccttagatgtccaactagaaatattactaggaaagttacttttcaaagcaggaatgtgctgggaagtaggagacagcaactccctcctctctccccaaaattattggatcaaaaaagaaattccatccatctcagaatctgtgagtcctcctcacataaatctgagggaaaaggctgtgtcactgcatctttgcaggaagaaagagaagcaagagctagacacacttcagaatatatcttagtttcccctttcccagtttaacatgaaaatgaaaaaagaaaaaaatgaaaaacaaaaacaaaagaagccttcctctcacctcattttgtaaatgaaaaatccctaattcagtgaattcacctagtcactgcaaatgtatctgaatagtgcttggtgtgcttgccagtctgatcatccactcattctactaacatctttttgcacccactctgtcaagctctagcctagacctttagtgtgccatgcagtcacaggtctgaaaagcagcatcatccaaaccttacttaatctctaaaatctcagctggtggacagctcatgattagttcagcccacttcctcccccttagttgagtttgcagcaggacgcaggagataagcacttccaagcaagtctgatttatatatcaaactcggtctccatcccaggccagctgaccctcagagccagcaatgctctgtgcttcctccctgcgtcacggcttggcaagagctgcctctgctgagcagtgtgtgtgatggagacggaggccgctgaaggccgagtgcttgcaggcttgtgaactgccatcgaacacaatccaaactctggaaatgttcctgaccacctaagccctcaacaacgtaatgcctgtatgtgctgtttttcagtaaactccttgttcatgtcatatgccattgtggggtgcggtggtgtcgggtgggggggtggggtgtggggtgggggcgggg

SEQ ID NO: 436197 - DNA, 443 bp, Homo sapiens
ggaaattctcagtgagttattttatctttggtaggtggcctgaacacctgagggactggacatcccatgttcagcaatgtcaatggcatcaggagggcgccccaagggccccatcgcttcccttcatgcatccattgttctgttcattcattcatccatacatccacctgcctctgagctttcacctctgactccctaactccatcagacctctacgcaccataagactctgccagaactgagaagccaacatttctacatagactcaacctcaccctctcctagttttccaacaagacactccaaagccaactggatttctcccctgtgctccaaatgactttgtacaagtgctggagttagcacctccctctgcccttaactggctggaactggttcattctccattactgcaagagaatggaagtcttaatagaaggaag

SEQ ID NO: 436198 - DNA, 6242 bp, Homo sapiens
  misc_feature (41)..(41): n is a, c, g, or t
cagggctgacagcacacacggcctgggggcctagagaaggnttgctgatcacctgccacccagggtcggggccccgcaccatccgggggcgagctcccgggaaggggctccgcctctacacccaccccccaacctctgacatcgccggccgaacgggagctgccgcttccttcccggccccgctgcacctccccagggagccgagggcgggcgtggacgggaccgacgtggaacgcattctgtagcccagacgggcggccccggcggcttcgggagtggggtcacgcccagctggagaagcagttagggcggacgaagcaggagccgcggggctgggaggattccagtcggaacgcaaccgatcctggggaggcgagaggtgaatcaacctggacccttccacagcctggctgctaggccagcagtgcgactcccttccgagctgagcttaccctgggcgcaaacgagcgaggcaggggcgcgagtggaagctggagttccggggtgggcggggaggcgactgtccgtggtgctgagcgccggcgagagcgggcgcggagcggctgatcggctccctcgaactggggaggtccagtggggtcgcttagggcccaaagcccccacccggctccaaaagctcccagggcctccccaggcaccggtgctcggcccttccttcggtcagaaagtcgccccctgggggcagttcgtcccaaagggtttcctcgaaagaatctgagagggcgcagtccttgaccgagggaatctctctgtgtagccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtggaatggcagcaaggacctgcaggacgtgtccatcactgtgctcaacgtcactctgaacgactctggcctctacacctgcaatgtgtcccgggagtttgagtttgaggcgcatcggccctttgtgaagacgacgcggctgatccccctaagagtcaccgaggaggctggagaggacttcacctctgtggtctcagaaatcatgatgtacatccttctggtcttcctcaccttgtggctgctcatcgagatgatatattgctacagaaaggtctcaaaagccgaagaggcagcccaagaaaacgcgtctgactaccttgccatcccatctgagaacaaggagaactctgcggtaccagtggaggaatagaacaggagcagtgtgacatgaggtggcctgaacacctgagggactggacatcccatgttcagcaatgtcaatggcatcaggagggcgccccaagggccccatcgcttcccttcatgcatccattgttctgttcattcattcatccatacatccacctgcctctgagctttcacctctgactccctaactccatcagacctctacgcaccataagactctgccagaactgagaagccaacatttctacatagactcaacctcaccctctcctagttttccaacaagacactccaaagccaactggatttctcccctgtgctccaaatgactttgtacaagtgctggagttagcacctccctctgcccttaactggctggaactggttcattctccattactgcaagagaatggaagtcttaatagaaggaagcaggagtgattagttcgggttaaagcaaaagtgtgtcatgaacttggattccctgaagtcagttttgtcaggttcatggcccactttgctacagcatcagagtgaagcacgcctgtctaggttctccagtgacagaaagatcctgaagcatggactaacatgctctctggagcttagtactccagagctagatcctgatgggtctctaaggttccctccaagaagacaaggacaggagacttgggaaggaccaatggtaatttaagtggctcttaaaaagtcatgcaacatgtttctggacacgttcctgatcctattgcgataatgtatgtgtgccctccctgtgggcacaccacctgggcattaggactgaaattcctgagttcttcctctcaaaatttctgtgcaccagtattattcctcattttacatacaggaggcaactaagactcatacagggctcaactgaataagaggcttaagaggataaactggagcagaaataagccttaggtgctgcccagtttacacttcctgggatggatgtttttgtttgttttgttttttgttttttttgtttgagatggagtctcactctgtcacctaggctagagtgcagtggtgtgatctcggctcactgcaacctctgcctcttgggttcaagcaattctcatgcctcggcctctccagtagctgggattacaggtgtgcaccaccacgcctggctaaattttgtatttttagtacagacagggtttgactatgttggccaggctagtcttgaactcctgacctcaaatgacccacccacctcagcctcccaaagtgctgagattacaggcgtgaggcactgcgcccggtggataactttgtttctgaaaagactgacattgaacttgtctatggcaatgcttctttcacaagcacggactgggctgaggtcaactctgatagattcagatgactagaaattggccaaaaaagcagggagaagaacatgaggtagacttaaagaacttcctttatgtaaagatctgtgactctgaaatatcctccaaaaggagagtgcatctgagactgatatttaaactaagaaaaatgtttagtctgagatggatcataagtaaatgagcagtgtgagaggggagggatgggtaggtgctttccaaatacttcgcctatgaatgcataattttcagatttttttcccctagattttgagggagcagagaaactggaaaaaactttagtcaatatctcgtgtttcattttaattaagtgacaggtccaagtgtgacatccttcagcacccagggacaagagaggggaaagatgctttatggaatgtaagaagatgaaggtgactgggattcagcgagagagaggtccctcagacctgggacctccctttatagggaaagaccatattccataggtttagggctttaccttaaaagctcatttttttcattcttccatccctaggaaagtacttaaaaccagacttttaaatttttatttatttattattatttttttgagacagattctcactctgtctcccaggctagagtgcagtggtgcaatctcagctcactgcagcctcaactgccccaggtttaagcaatcctcccacctcagcccccaggtaactgggactacaggcatgcaccaccatgcctggctaatttttgtattttatgtagagacaggggtcttgccatgtcgcccaggctgatcttgaactcctgggctcaagcaatctgccagcctcagcctctcaaagtgctgggattacaggcctgagcaactgtgcctggcccaaaaccagaccgttaacacattaaagagtctgattttgttgaagaaaatatttgcaataaattcaagactcttcttattggtaattttccacacaatccctctgaaataagggagaggatatagacctttttaactttatagttagaaaaattggcctcagtgtgaaatttttccagtcccatagctcatggatgccaccagcttgcggtagtagcaagatgcttactaccacaccgttttcctcggtggcccaatagctcgtgtatctaagttgaacccggcagtatgcatgattgcctttttctcttctttttaaaaaaacccaactcagatgctgcttgcgtggcttttaatgaagctgaatggtatctatcacttatttatccttgacaggttatcttccccactcttcctttttctaacttctccattcttctcattcttgacactttcattagaactatatggtttacgaagtattttcacttaactattttatttcttctctataactggtcctgtgaggtcacattacaaaagaagaaactgagggtctctgaggttaagtagctttactaaattataaggaaacctagctggtaggtagacagcaagaatccaggtcttctgactcctctttcagttctctttccacttagaccatagctgcttccttttcttattttttagcttccatctaaccattgcctatcttgcctgtcctaatgttctccatcttctctcacccctaatcccactcactgcttctctaccactttgctttttggtggatgctagcaatgtgctttgagagtcagtcctattttggttctctttctagttggtttgtacatcattatttctcctgaattgcaattaaactccttcctgggagatttgataatgactgtaaatcaataaggtactgtgatcaccagcctacttccaatctccacccacctccctgtctcttcccataatcctacgaaagacccagactagatgtctgtttctctggaagctttatctggcatgatgttgcttattaaagggcttagaagagttctcaagggctattaatatcactttagaaaccccatctgttgtcttggtgctggatatttcccatgtctgatcctcaataacacaattcactaaaggccaagcttggctcaatctgattttcccattcttactacttcacagccatgaatgtgattgctcaatccagttggccctgagagcaccttgccctgctgaccttcactgtcacctcggtcttgaatcagagccccaacccaaacactccctgcctgtccctaccccagcctttattctcaccacttgtttaacggcatgaccttttagtttctccattcccagacacccacacacccagacttccttctgagttgcaggtttctccttagatgtccaactagaaatattactaggaaagttacttttcaaagcaggaatgtgctgggaagtaggagacagcaactccctcctctctccccaaaattattggatcaaaaaagaaattccatccatctcagaatctgtgagtcctcctcacataaatctgagggaaaaggctgtgtcactgcatctttgcaggaagaaagagaagcaagagctagacacacttcagaatatatcttagtttcccctttcccagtttaacatgaaaatgaaaaaagaaaaaaatgaaaaacaaaaacaaaagaagccttcctctcacctcattttgtaaatgaaaaatccctaattcagtgaattcacctagtcactgcaaatgtatctgaatagtgcttggtgtgcttgccagtctgatcatccactcattctactaacatctttttgcacccactctgtcaagctctagcctagacctttagtgtgccatgcagtcacaggtctgaaaagcagcatcatccaaaccttacttaatctctaaaatctcagctggtggacagctcatgattagttcagcccacttcctcccccttagttgagtttgcagcaggacgcaggagataagcacttccaagcaagtctgatttatatatcaaactcggtctccatcccaggccagctgaccctcagagccagcaatgctctgtgcttcctccctgcgtcacggcttggcaagagctgcctctgctgagcagtgtgtgtgatggagacggaggccgctgaaggccgagtgcttgcaggcttgtgaactgccatcgaacacaatccaaactctggaaatgttcctgaccacctaagccctcaacaacgtaatgcctgtatgtgctgtttttcagtaaactccttgttcatgtcaataaagtatccctgaaaaccaaataaataaatatataactaacacaattacaattaattggcgggcgctattactaccgcagggatggtttaaaaccatgtcttacataactaaattggcttgcgtacactcattttttgaatcgacgctagataggttctgacgtatggctatccttacattagccacgcatggggagtc

SEQ ID NO: 436199 - DNA, 5843 bp, Homo sapiens
  misc_feature (41)..(41): n is a, c, g, or t
cagggctgacagcacacacggcctgggggcctagagaaggnttgctgatcacctgccacccagggtcggggccccgcaccatccgggggcgagctcccgggaaggggctccgcctctacacccaccccccaacctctgacatcgccggccgaacgggagctgccgcttccttcccggccccgctgcacctccccagggagccgagggcgggcgtggacgggaccgacgtggaacgcattctgtagcccagacgggcggccccggcggcttcgggagtggggtcacgcccagctggagaagcagttagggcggacgaagcaggagccgcggggctgggaggattccagtcggaacgcaaccgatcctggggaggcgagagccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtggaatggcagcaaggacctgcaggacgtgtccatcactgtgctcaacgtcactctgaacgactctggcctctacacctgcaatgtgtcccgggagtttgagtttgaggcgcatcggccctttgtgaagacgacgcggctgatccccctaagagtcaccgaggaggctggagaggacttcacctctgtggtctcagaaatcatgatgtacatccttctggtcttcctcaccttgtggctgctcatcgagatgatatattgctacagaaaggtctcaaaagccgaagaggcagcccaagaaaacgcgtctgactaccttgccatcccatctgagaacaaggagaactctgcggtaccagtggaggaatagaacaggagcagtgtgacatgaggtggcctgaacacctgagggactggacatcccatgttcagcaatgtcaatggcatcaggagggcgccccaagggccccatcgcttcccttcatgcatccattgttctgttcattcattcatccatacatccacctgcctctgagctttcacctctgactccctaactccatcagacctctacgcaccataagactctgccagaactgagaagccaacatttctacatagactcaacctcaccctctcctagttttccaacaagacactccaaagccaactggatttctcccctgtgctccaaatgactttgtacaagtgctggagttagcacctccctctgcccttaactggctggaactggttcattctccattactgcaagagaatggaagtcttaatagaaggaagcaggagtgattagttcgggttaaagcaaaagtgtgtcatgaacttggattccctgaagtcagttttgtcaggttcatggcccactttgctacagcatcagagtgaagcacgcctgtctaggttctccagtgacagaaagatcctgaagcatggactaacatgctctctggagcttagtactccagagctagatcctgatgggtctctaaggttccctccaagaagacaaggacaggagacttgggaaggaccaatggtaatttaagtggctcttaaaaagtcatgcaacatgtttctggacacgttcctgatcctattgcgataatgtatgtgtgccctccctgtgggcacaccacctgggcattaggactgaaattcctgagttcttcctctcaaaatttctgtgcaccagtattattcctcattttacatacaggaggcaactaagactcatacagggctcaactgaataagaggcttaagaggataaactggagcagaaataagccttaggtgctgcccagtttacacttcctgggatggatgtttttgtttgttttgttttttgttttttttgtttgagatggagtctcactctgtcacctaggctagagtgcagtggtgtgatctcggctcactgcaacctctgcctcttgggttcaagcaattctcatgcctcggcctctccagtagctgggattacaggtgtgcaccaccacgcctggctaaattttgtatttttagtacagacagggtttgactatgttggccaggctagtcttgaactcctgacctcaaatgacccacccacctcagcctcccaaagtgctgagattacaggcgtgaggcactgcgcccggtggataactttgtttctgaaaagactgacattgaacttgtctatggcaatgcttctttcacaagcacggactgggctgaggtcaactctgatagattcagatgactagaaattggccaaaaaagcagggagaagaacatgaggtagacttaaagaacttcctttatgtaaagatctgtgactctgaaatatcctccaaaaggagagtgcatctgagactgatatttaaactaagaaaaatgtttagtctgagatggatcataagtaaatgagcagtgtgagaggggagggatgggtaggtgctttccaaatacttcgcctatgaatgcataattttcagatttttttcccctagattttgagggagcagagaaactggaaaaaactttagtcaatatctcgtgtttcattttaattaagtgacaggtccaagtgtgacatccttcagcacccagggacaagagaggggaaagatgctttatggaatgtaagaagatgaaggtgactgggattcagcgagagagaggtccctcagacctgggacctccctttatagggaaagaccatattccataggtttagggctttaccttaaaagctcatttttttcattcttccatccctaggaaagtacttaaaaccagacttttaaatttttatttatttattattatttttttgagacagattctcactctgtctcccaggctagagtgcagtggtgcaatctcagctcactgcagcctcaactgccccaggtttaagcaatcctcccacctcagcccccaggtaactgggactacaggcatgcaccaccatgcctggctaatttttgtattttatgtagagacaggggtcttgccatgtcgcccaggctgatcttgaactcctgggctcaagcaatctgccagcctcagcctctcaaagtgctgggattacaggcctgagcaactgtgcctggcccaaaaccagaccgttaacacattaaagagtctgattttgttgaagaaaatatttgcaataaattcaagactcttcttattggtaattttccacacaatccctctgaaataagggagaggatatagacctttttaactttatagttagaaaaattggcctcagtgtgaaatttttccagtcccatagctcatggatgccaccagcttgcggtagtagcaagatgcttactaccacaccgttttcctcggtggcccaatagctcgtgtatctaagttgaacccggcagtatgcatgattgcctttttctcttctttttaaaaaaacccaactcagatgctgcttgcgtggcttttaatgaagctgaatggtatctatcacttatttatccttgacaggttatcttccccactcttcctttttctaacttctccattcttctcattcttgacactttcattagaactatatggtttacgaagtattttcacttaactattttatttcttctctataactggtcctgtgaggtcacattacaaaagaagaaactgagggtctctgaggttaagtagctttactaaattataaggaaacctagctggtaggtagacagcaagaatccaggtcttctgactcctctttcagttctctttccacttagaccatagctgcttccttttcttattttttagcttccatctaaccattgcctatcttgcctgtcctaatgttctccatcttctctcacccctaatcccactcactgcttctctaccactttgctttttggtggatgctagcaatgtgctttgagagtcagtcctattttggttctctttctagttggtttgtacatcattatttctcctgaattgcaattaaactccttcctgggagatttgataatgactgtaaatcaataaggtactgtgatcaccagcctacttccaatctccacccacctccctgtctcttcccataatcctacgaaagacccagactagatgtctgtttctctggaagctttatctggcatgatgttgcttattaaagggcttagaagagttctcaagggctattaatatcactttagaaaccccatctgttgtcttggtgctggatatttcccatgtctgatcctcaataacacaattcactaaaggccaagcttggctcaatctgattttcccattcttactacttcacagccatgaatgtgattgctcaatccagttggccctgagagcaccttgccctgctgaccttcactgtcacctcggtcttgaatcagagccccaacccaaacactccctgcctgtccctaccccagcctttattctcaccacttgtttaacggcatgaccttttagtttctccattcccagacacccacacacccagacttccttctgagttgcaggtttctccttagatgtccaactagaaatattactaggaaagttacttttcaaagcaggaatgtgctgggaagtaggagacagcaactccctcctctctccccaaaattattggatcaaaaaagaaattccatccatctcagaatctgtgagtcctcctcacataaatctgagggaaaaggctgtgtcactgcatctttgcaggaagaaagagaagcaagagctagacacacttcagaatatatcttagtttcccctttcccagtttaacatgaaaatgaaaaaagaaaaaaatgaaaaacaaaaacaaaagaagccttcctctcacctcattttgtaaatgaaaaatccctaattcagtgaattcacctagtcactgcaaatgtatctgaatagtgcttggtgtgcttgccagtctgatcatccactcattctactaacatctttttgcacccactctgtcaagctctagcctagacctttagtgtgccatgcagtcacaggtctgaaaagcagcatcatccaaaccttacttaatctctaaaatctcagctggtggacagctcatgattagttcagcccacttcctcccccttagttgagtttgcagcaggacgcaggagataagcacttccaagcaagtctgatttatatatcaaactcggtctccatcccaggccagctgaccctcagagccagcaatgctctgtgcttcctccctgcgtcacggcttggcaagagctgcctctgctgagcagtgtgtgtgatggagacggaggccgctgaaggccgagtgcttgcaggcttgtgaactgccatcgaacacaatccaaactctggaaatgttcctgaccacctaagccctcaacaacgtaatgcctgtatgtgctgtttttcagtaaactccttgttcatgtcaataaagtatccctgaaaaccaaataaataaatatataactaacacaattacaattaattggcgggcgctattactaccgcagggatggtttaaaaccatgtcttacataactaaattggcttgcgtacactcattttttgaatcgacgctagataggttctgacgtatggctatccttacattagccacgcatggggagtc

SEQ ID NO: 436200 - DNA, 949 bp, Homo sapiens
atatcattctgggattgggaatatgtaaactcaactggagattttttttcataaaaatttatatagttccagccctctcattgcttcctatcctaaatcctcttccagtctgtccatccctcactaccatgatagtctacattctgataagctgtgaggccactgccaagggagggagaaatggtcactttctggtggtggttaatgctttgttagatagcttcatccagtcaatagttgaaaagttttcacataatccagtattggcatcagagccagaaatgccctccctaggtccaggaccaaagataaaacaaacacgaggaacatgtagcgtctacacaggaaagtaaagaattatagaattaactaattctacttgaaatcaggagttttataaaacaacatttttagacgtggtcatcttttattggtttccatcatctcttccccttctctctgggaacagttacccgggtattctttgggaagctatcctttctcagctatgtggtttggcaccaccaccatcttcatgagtggaccctgtttggcttgtgtcaatcagtttatcccatccccttggccacagagccattgtgatatgaggagatactggctcttctggaaaagagaggcttttcttcatcgagagctaccagaggagatattatctgtcctctgtgtggcacataggaaaatgtgagacctagaattatagcaactttttttttctgttaaaaggggagattctcaagcttccaggtgctaccatatggagcctaaggataaagccaataccaaagaaaacagtgactaaacagagagaaactaggtccttggtgacatcttttgagccactagaccaagctttacctgaagcagagctacctcagaacttttcagctatgtgagccaataaacatctgtcaaacgaaaaaagaaaaaa

SEQ ID NO: 436201 - DNA, 730 bp, Homo sapiens
cgtttttgtcgcgggaggttttggtttgtgaggatcggcgagtggcgcccaccatctctgcttgctgaaaagctgcagaggccgccaggagcccacgcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatgtacaaacaaaaaaacaaaaaacaacacaacacaaaaacacaaaaaacaaaaacaaaagggg

SEQ ID NO: 436202 - DNA, 1011 bp, Homo sapiens
tgcccttttcccctcgggcagcggaggcgagcaccgcgaacgccgtgtcccgagcgccgccgcctgcggacgcctcacgggccgggaagggatgcggcctttctcctaaggcaccagtttctccaatgtttaacttatacatgcatcagaatgacagtgaggcgttggtgagagctgctctggttgctaatggagatctggcctgccacagtgggagcagagcttgcccagtgcgccgggacgactgcgggctccatccattccgctcccagggcggttgtcggccaggaccgtgagctgtcaggtcccccgcgggatccttcctggagcttacactatagtaggaggcagccagtacttgcaagcacggggtcgcgggaactacgacctcacccaggccaggcgacctttctctcaagaaggagatgtcagaggcccctcgtgacagcgagcttccggggacagggctcctaatgtgtagagatggggtttcaccacgttggccaggatggtcttgatctcctgacctcatgatctgccttcctcagcctcctattgatcaaagttttacatgatgcaggagccttcagagtgaagacccaaagatacaggatacagtacgggatcctttctggaatggaggtcttatgagctgctattgaacacggcagatggagtctcactctgtcgccaggctgcagtacaatggtgtgatctcggctcactgcaacctccacctctcgggttcaagtgattcttctgcctcagcctcctgagtagctgggactacagaatcacaccctttctccaggaccactctccttctgctggaagtacgttcttcagtgagttccttgagtctcactctcctgagtttcgtgttgtgataaattctgtttcccatctggaaatgccctttaccgtgagcagattcttgaacaaccatcaatttcaactcctgattctaatttgatggtgaagagtcccaagtcacactcactgtatcccatg

SEQ ID NO: 436203 - DNA, 562 bp, Homo sapiens
actgacaccgtgtgtgtgtgtgtgtgtgtgtgtgtgtgtgtgtgtgtgtgtgtgttgccacccagctgtgctaattggatttgggcaattatagataatgattatagtcctcaaaatcaccatgatacaatcaatccagctcctgatgtccaacaaataagccccttactggacataaaagtgccacaatggctcactgacaacagattgctaaagtatcaagtgttgttagaaatcccacaggtaacagttgagtggtgctccaccctcatcccagcctccttactgccattaccaggagaggatgactcaacacattcatgttgtgagatacttaaccaaatttatgccagatgggaagacttaaaggatcagcccttggacaatctggtcaaaatatggttttcagatgggagcagttttgttcagaatgaaactatatatgcagggtacacagaggctaaagctctatccttggggacctcaggacaactagcaaaactcatcttttaaccacaggcctaacactaggttaaggctcccggggatctctagacaccac

SEQ ID NO: 436204 - DNA, 462 bp, Homo sapiens
tcctaatggacttgtctttacattctagcctttctcctaaggcaccagtttctccaatgtttaacttatacatgcatcagaatgacagtgaggcgttggtgagagctgctctggttgctaatggagatctggcctgccacagtgggagcagagcttgcccagtgcgccgggacgactgcgggctccatccattccgctcccagggcggttgtcggccaggaccgtgagctgtcaggtcccccgcgggatccttcctggagcttacactatagtaggaggcagccagtacttgcaagcacggggtcgcgggaactacgacctcacccaggccaggcgacctttctctcaagaaggagatgtcagaggcccctcgtgacagcgagcttccggggacagggctcctaatgtgcttctgcagcagcagctccttgaagggtcgggctctgaaagtgcttacttttt

SEQ ID NO: 436205 - DNA, 5626 bp, Homo sapiens
tgcccttttcccctcgggcagcggaggcgagcaccgcgaacgccgtgtcccgagcgccgccgcctgcggacgcctcacgggccgggaagggatgcggcctttctcctaaggcaccagtttctccaatgtttaacttatacatgcatcagaatgacagtgaggcgttggtgagagctgctctggttgctaatggagatctggcctgccacagtgggagcagagcttgcccagtgcgccgggacgactgcgggctccatccattccgctcccagggcggttgtcggccaggaccgtgagctgtcaggtcccccgcgggatccttcctggagcttacactatagtaggaggcagccagtacttgcaagcacggggtcgcgggaactacgacctcacccaggccaggcgacctttctctcaagaaggagatgtcagaggcccctcgtgacagcgagcttccggggacagggctcctaatgtgtagagatggggtttcaccacgttggccaggatggtcttgatctcctgacctcatgatctgccttcctcagcctcctattgatcaaagttttacatgatgcaggagccttcagagtgaagacccaaagatacaggatacagtacgggatcctttctggaatggaggtcttatgagctgctattgaacacggcagagcctgttggtgacctgcacacaggagccctccagtcagtactgattgaattactcaaggctgcctctctgcaaagttgagcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtattggttgtgtcttggtgaggctgaggcccgcaggccagggccgggctttaaaaatagctgcagccttggtggtggccttcttcgtgctatggttcccatacaatctcaccttgtttctgcatacgctgttggacctgcaagtattcgggaactgtgaggtcagccagcatctagactacgcactccaggtaacagagagcatcgccttccttcactgctgcttttcccccatcctgtatgccttctccagtcaccgcttccgccagtacctgaaggctttcctggctgccgtgcttggatggcacctggcacctggcactgcccaggcctcattatccagctgttctgagagcagcatacttactgcccaagaggaaatgactggcatgaatgaccttggagagaggcagtctgagaactaccctaacaaggaggatgtggggaataaatcagcctgagtgaccaaattttggtctggtgggaacagatgggaaccagctcaattgggtgtccactcaaagtgctctctccaggggcctcagtgactgtgttgctaaacccagtggtcagttctcagttctcagccatcagcagcatttgctcgccccgccttcttcctccactttcttcacttgcttccaggataccacgctttcttttctgaattgctacaatctttcttccttccttccttgcttccttccttccttccttccctctctccctccctccctccctcgcttcttcccttcctcctttcctcccttcctactttccttccttccttctgacagggtcttgctctattgctctgtcacccaggctggaatgcagtggcgagatctccgctcactgtagcctcctccccctgggttgaagcaattctcatgcctcagcctcccaagtagccaggactataggcacctgccaccatgcctggctaatttttgtattttttttctttctttctttcttttcttttttttttttttttgagacggagtctcactcttgttgcccaggctggacaacaatggcgcgatctcggctcactgcaacctccacctcccggattcaagcgattctcctgcctcagcctcctgagtagctggaactacatgcgcgtgccaccacgcacagctaatttttataattttagtagagatggggtttcactgcgttggccaggatgatctcgatctcttgaccttgggatccacccgccttggcctcccaaagtgctgggattacaggtgtgagccaccatgcctggccctaatttttgtgtttttattagaaacagagtttcaccatgttggccaggctggagaattgctgtaatagttttccaactggcccctgtccttcctctctcttgctctcctcccatctcatctgcacctagcagccagagtgatcctgatactctcggcctttacttccgcctccctcagagcagcagcctgtcaaaacaccagattacaacaaatttagtttaaaggtctcaattagcgttattggcaattctagaatcaggcaacagactcattgaatcaggaacagattcactccataaaatacagagagtgctgcaatgagctgggtagaagaggttagttttatagacaggaaggggctgtcaaaggcagaaagaaatgaagaacaaaaaaaaagattgatttttttttttttgagacaggatctcactctgtcatccaggctgaagtccaatcccacaatcatggctcactgcagccaccacctcctgagctcaagtgatcctcccatctaagcccccaagtagctaggactacaggagcacaccaccacacctggctaatttttgtattttttgtggagacagggtctcagtatgttacccaggttggactggaaacccttggctcaagcaatttgcctgcctcagcctcccaaagtgctgggattacaggcgtgagccactgcacagggccagattcatcatttcaaagttactttctatatgcggccggaacagggtggttgacatcagttttcttcaggttactttttaataatgattaaaacggggaacttcattatcatgagcatggttactgtctgcattattacgccaactgaaactgtcatgtttgggaatttggctgttaactctgtctccaggagtctcaaaggtcagataacaacttagttttggtttgaggacatggaactttaatacgacagattccattttggtttggtctggtcagctgggacctagtgcaggaggttagtccaaaacaatggccttccatagtttttacttaacaagcccaactccttacggtaatcctttaaggcctatgtgatctgcccccaccctggctacactctttgcccttatgtccaccagcctccagtgctccagacacaactgatctcaaatactcctgacacatccccctggggattcctcttcctggattactctcctctcagctgtctgcttggctcactctctcaccttctgaggtcttagctcagataccacctttcactcacctgtccaacctatttaacacaaactggcccatctctgacgctcctgatcttcctgatgctctatttttaaattttttcaatagtgcttatttctttcagacattgtatatgtttctcctatttgtgatgttcagtggctactgtccccacccacattgtcccagggtgaattccacaaggtaggggatcttggttaggctcactgctgtacccaaccccctaacacagggcctggtgtgtaggttttcagaaagtatctgtaaaatgcatgggtggaggagggagcattttccttctggcactgctggggaaaaagaacctaaggccctccactcaccagggttccacattctctgtagtccagctgggaaatgctattaaaaggaccattctcgtagccttgatggtggacccagcatctggcaatcaggagggccttgaagtactctgcctagggaatgtcccaggaccatatacagtctgcagaaggaggcagtgaacacacttggcctaggccccatctcaggagccttcacatctccctgggacctgcacaatcaagtccaaaatctttgtctgatgtcaaggctagggcttttgcaaataggatcccatacatcttccagccctcatactcctccactcccttttcatttcctgaacattccaacttctatgcctttgctcttgtgggctccctcatgtaattaggataatttccagccaggtattccctcacccttgttttacaactgaatcccactttctctgggactccactgcttggtcactctgccctgtgctttgagaggaggttgggtggagcatgggacatgggccatttactgccttcacatttccctggtcacggtgatttttttaggggtgggcacatgacctaggtagagccaatgaagtgcaatatcactagaacatgtgagaagagaggcatgaaaccgaagctgagagggtttgagatctggagctactccttcctccacccaaacttcagaaggtgaaggagatagtgcatgtgagtgagcagatcccgagggcactgtttgagcctcagaatcaaagcacttctgaagctagtcccaatcttggattcgacagttacaagaaccaataaattcctttccttgtggagtcatgttgttttgttacttgcaacctaaagattcctgactgatatactgtgcccagtgcttttctcttcatatctctaatgcttggcattctccctgccccctgacacatccactgagaagcctttccccagggagctgcctgcccacatggcatctctctctcccgagcttctaaagcacccactgctcttcccacctcatagaactacctggtgcaacctgcccacgtcccagcatgtctgccctgcacaattgaacgtggaacctggcacacaggaaaggaaactttttggtggatggaatggagggtaggagaacagacggctgggtgaatgtaagctccatgagagcagggactttgccatgtgtaaactctgcatcccctgtgcttcaacacatgctcagagcatagtagactttttttggaatgaatggataagttttt

SEQ ID NO: 436206 - DNA, 4958 bp, Homo sapiens
acttccctgaggaagaggcactggcgctgccgctctcctcccaggcttgtggtggacattctcaagcaagtcattctggctccgcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtattggttgtgtcttggtgaggctgaggcccgcaggccagggccgggctttaaaaatagctgcagccttggtggtggccttcttcgtgctatggttcccatacaatctcaccttgtttctgcatacgctgttggacctgcaagtattcgggaactgtgaggtcagccagcatctagactacgcactccaggtaacagagagcatcgccttccttcactgctgcttttcccccatcctgtatgccttctccagtcaccgcttccgccagtacctgaaggctttcctggctgccgtgcttggatggcacctggcacctggcactgcccaggcctcattatccagctgttctgagagcagcatacttactgcccaagaggaaatgactggcatgaatgaccttggagagaggcagtctgagaactaccctaacaaggaggatgtggggaataaatcagcctgagtgaccaaattttggtctggtgggaacagatgggaaccagctcaattgggtgtccactcaaagtgctctctccaggggcctcagtgactgtgttgctaaacccagtggtcagttctcagttctcagccatcagcagcatttgctcgccccgccttcttcctccactttcttcacttgcttccaggataccacgctttcttttctgaattgctacaatctttcttccttccttccttgcttccttccttccttccttccctctctccctccctccctccctcgcttcttcccttcctcctttcctcccttcctactttccttccttccttctgacagggtcttgctctattgctctgtcacccaggctggaatgcagtggcgagatctccgctcactgtagcctcctccccctgggttgaagcaattctcatgcctcagcctcccaagtagccaggactataggcacctgccaccatgcctggctaatttttgtattttttttctttctttctttcttttcttttttttttttttttgagacggagtctcactcttgttgcccaggctggacaacaatggcgcgatctcggctcactgcaacctccacctcccggattcaagcgattctcctgcctcagcctcctgagtagctggaactacatgcgcgtgccaccacgcacagctaatttttataattttagtagagatggggtttcactgcgttggccaggatgatctcgatctcttgaccttgggatccacccgccttggcctcccaaagtgctgggattacaggtgtgagccaccatgcctggccctaatttttgtgtttttattagaaacagagtttcaccatgttggccaggctggagaattgctgtaatagttttccaactggcccctgtccttcctctctcttgctctcctcccatctcatctgcacctagcagccagagtgatcctgatactctcggcctttacttccgcctccctcagagcagcagcctgtcaaaacaccagattacaacaaatttagtttaaaggtctcaattagcgttattggcaattctagaatcaggcaacagactcattgaatcaggaacagattcactccataaaatacagagagtgctgcaatgagctgggtagaagaggttagttttatagacaggaaggggctgtcaaaggcagaaagaaatgaagaacaaaaaaaaagattgatttttttttttttgagacaggatctcactctgtcatccaggctgaagtccaatcccacaatcatggctcactgcagccaccacctcctgagctcaagtgatcctcccatctaagcccccaagtagctaggactacaggagcacaccaccacacctggctaatttttgtattttttgtggagacagggtctcagtatgttacccaggttggactggaaacccttggctcaagcaatttgcctgcctcagcctcccaaagtgctgggattacaggcgtgagccactgcacagggccagattcatcatttcaaagttactttctatatgcggccggaacagggtggttgacatcagttttcttcaggttactttttaataatgattaaaacggggaacttcattatcatgagcatggttactgtctgcattattacgccaactgaaactgtcatgtttgggaatttggctgttaactctgtctccaggagtctcaaaggtcagataacaacttagttttggtttgaggacatggaactttaatacgacagattccattttggtttggtctggtcagctgggacctagtgcaggaggttagtccaaaacaatggccttccatagtttttacttaacaagcccaactccttacggtaatcctttaaggcctatgtgatctgcccccaccctggctacactctttgcccttatgtccaccagcctccagtgctccagacacaactgatctcaaatactcctgacacatccccctggggattcctcttcctggattactctcctctcagctgtctgcttggctcactctctcaccttctgaggtcttagctcagataccacctttcactcacctgtccaacctatttaacacaaactggcccatctctgacgctcctgatcttcctgatgctctatttttaaattttttcaatagtgcttatttctttcagacattgtatatgtttctcctatttgtgatgttcagtggctactgtccccacccacattgtcccagggtgaattccacaaggtaggggatcttggttaggctcactgctgtacccaaccccctaacacagggcctggtgtgtaggttttcagaaagtatctgtaaaatgcatgggtggaggagggagcattttccttctggcactgctggggaaaaagaacctaaggccctccactcaccagggttccacattctctgtagtccagctgggaaatgctattaaaaggaccattctcgtagccttgatggtggacccagcatctggcaatcaggagggccttgaagtactctgcctagggaatgtcccaggaccatatacagtctgcagaaggaggcagtgaacacacttggcctaggccccatctcaggagccttcacatctccctgggacctgcacaatcaagtccaaaatctttgtctgatgtcaaggctagggcttttgcaaataggatcccatacatcttccagccctcatactcctccactcccttttcatttcctgaacattccaacttctatgcctttgctcttgtgggctccctcatgtaattaggataatttccagccaggtattccctcacccttgttttacaactgaatcccactttctctgggactccactgcttggtcactctgccctgtgctttgagaggaggttgggtggagcatgggacatgggccatttactgccttcacatttccctggtcacggtgatttttttaggggtgggcacatgacctaggtagagccaatgaagtgcaatatcactagaacatgtgagaagagaggcatgaaaccgaagctgagagggtttgagatctggagctactccttcctccacccaaacttcagaaggtgaaggagatagtgcatgtgagtgagcagatcccgagggcactgtttgagcctcagaatcaaagcacttctgaagctagtcccaatcttggattcgacagttacaagaaccaataaattcctttccttgtggagtcatgttgttttgttacttgcaacctaaagattcctgactgatatactgtgcccagtgcttttctcttcatatctctaatgcttggcattctccctgccccctgacacatccactgagaagcctttccccagggagctgcctgcccacatggcatctctctctcccgagcttctaaagcacccactgctcttcccacctcatagaactacctggtgcaacctgcccacgtcccagcatgtctgccctgcacaattgaacgtggaacctggcacacaggaaaggaaactttttggtggatggaatggagggtaggagaacagacggctgggtgaatgtaagctccatgagagcagggactttgccatgtgtaaactctgcatcccctgtgcttcaacacatgctcagagcatagtagactttttttggaatgaatggataagttttt

SEQ ID NO: 436207 - DNA, 4210 bp, Homo sapiens
tgcccttttcccctcgggcagcggaggcgagcaccgcgaacgccgtgtcccgagcgccgccgcctgcggacgcctcacgggccgggaagggatgcggcctttctcctaaggcaccagtttctccaatgtttaacttatacatgcatcagaatgacagtgaggcgttggtgagagctgctctggttgctaatggagatctggcctgccacagtgggagcagagcttgcccagtgcgccgggacgactgcgggctccatccattccgctcccagggcggttgtcggccaggaccgtgagctgtcaggtcccccgcgggatccttcctggagcttacactatagtaggaggcagccagtacttgcaagcacggggtcgcgggaactacgacctcacccaggccaggcgacctttctctcaagaaggagatgtcagaggcccctcgtgacagcgagcttccggggacagggctcctaatgtgtagagatggggtttcaccacgttggccaggatggtcttgatctcctgacctcatgatctgccttcctcagcctcctattgatcaaagttttacatgatgcaggagccttcagagtgaagacccaaagatacaggatacagtacgggatcctttctggaatggaggtcttatgagctgctattgaacacggcagagcctgttggtgacctgcacacaggagccctccagtcagtactgattgaattactcaaggctgcctctctgcaaagttgaggcggtggagaactactgaggacttctgagcagagaggttggtggaagaggaagcaccaaaaatccatctcatcacctagagagcattgtactggcagaactgtctaaagtgactattttggaactctgggatcaatttgaatacttgcagcttccaaaggaaagatgggcaatcacatctccataccacaggacacaccccttggatgcatcctcaagaactgggaaaagtttgacccacaagctctaaaaaggaaaaggctaattttttttgtcacacagcctggttctgatatggacttggggaccagcaatcttggccagaaaatggaagtattaattttaatactatccatcaactagattcgttttgctgccagcagggaaaatggacagaaatcccttatgcacaggctttcatggccgtaagagacaaccctgacctttgttgggcttgtaaaatggacccagtgatgatagcagccatcaccaggcaactcctccagtagatttgggagaccctttatcagatttgcacagggctcaagccccagaggaaccaaaggtggaatttagttcaaacattgcctcttttattcccattatatccaagtctcccagtcccatagccttcccctccctacccagggccaccctctggataccacccccttaagttatccccacttcaggaggttagcagccctattgggtcaactagagtccagactccattcactatgtaagacctgagccagattaaaatggagctatggaagtttatggaaaaccctgactaatgcattgaagggttccattaactaggcttaacatttgaacttacttgggaggacttcacagtcacactaggccaaactctaagggagaacatgactccattatggaggcagcccagcaatttgcaagtgcaatgcacatgactgaccctggtggctaccttgtgagggccactgcccttccccaggttggcccccaactgggaatacaatacccaggggggtatatgggcagtgaaccacatccccataatggggatgaaggatagcagaggaaagcctgtaaactacaataaattggccttaatagatcaagactctcttgaaaatcccactactttcttagagaggctacattaggcccaagtgaaacatactaaccttgacccagacaccccagaaggatgccttcttttgtatccccatagacccatcttcccaattgctatttgcctttgaatgggaaaatgaaaaaggaaggagccaacagctcacctggactgtgcttctgcaaggttttagagatagtccccatttggttgggcaagccttggctaaagattttcaagacctgactcttgagggggcagatgtgtcctacagtatgtgaatgacctgctaatctcctcccccacaagacaactgggaatccaacatctagtccagacactacattttcttgcagacagagggtacaaagcatccaaggccaaggcacagcttctcagacaagaggtccaatacgtggggataatcctgatccctcgagaacataagttctccccagaacggatacaggccatccttaaaatacctatcccagccacccaaaatcagcatcaggcctttctagggatcacaggatattgcagactttagactgggttatggtgggattgttaagtccttatattagactctaaaagaagggactgatagggactcacttctctgggaaaaagatcaggagcaagcctttaggcagctaaagactgctctctcataagccccagcccttgggctacccatactaagcaaactgttttagcttttcatcaccaaaagccaaggtgtagccttaggagtcctaactcaaactgttgggtcaatcaaatgtcctgtaggttactttttaaagaacctagacccagtagcacacaggtggccacactgcctcaaggtagtggctgcacaagccctcctactggaggaggtcctcaaaatcaccatgatacaatcaatccagctcctgatgtccaacaaataagccccttactggacataaaagtgccacaatggctcactgacaacagattgctaaagtatcaagtgttgttagaaatcccacaggtaacagttgagtggtgctccaccctcatcccagcctccttactgccattaccaggagaggatgactcaacacattcatgttgtgagatacttaaccaaatttatgccagatgggaagacttaaaggatcagcccttggacaatctggtcaaaatatggttttcagatgggagcagttttgttcagaatgaaactatatatgcagggtacacagaggctaaagctctatccttggggacctcaggacaactagcaaaactcatcttttaaccacaggcctaacactaggggaagggaaaagaataaccatttatacagattccaaatatgcctttttggtgcttcatgcccaagccactatctggaaggaaagggagtacccagcaacttgggatactcctactaagtaggggccccaaatcttagagctactagaggccattcacttgacccaggaggtggcagtagagagggttctggaaatggcaggcactcattgggtaatggtcaagctatcataaaactgtccctctgaaatgagaagtggccatgactgggaccaagacagagaggagttctgcaacagatagaaaacatctggagccagcaaatcacaattccctgatcaggtttttgtttgtttttgttttgttttgttttgtttggggtggagtctcactctgtcacccaggctggagtacagtggcacgacctcggctcactgcaacctctgcctcccggattcaagtgattctcctgcctcagcctccccagtagctgagattacaggcacctgccaccacacctggctaattttttaaaatttttagtagagacaaggttttgccatgttggccaggctggtcttgaactcctgacctcaaatgatccacctgccttggcctcccaaagtgctgggcgtgagccaccgtgcccagcccctgatctggtcttaagcatggggcaaaagtagggggggaaatggtggtgtttgactggtatatgaccttcctctggaggtgatcaaccagtaagggaaaatcgctccaagtgagcatgcacacaacctcagtaaacacactgtgcatgtggcttctcccaagtactagcaggccactgcacatgtcacaactgagcaacagcccaccccaatggagggatcaagggaggagaagaaaaaccccggaaccaaaagccagtttataaaaatcctgagccaaaggctgaggggggcacttgatctctcaagttccctacttggccctcttccaagtgtgatttgcttcttttaataaacctttgcctctgcttt

SEQ ID NO: 436208 - DNA, 3099 bp, Homo sapiens
tgcccttttcccctcgggcagcggaggcgagcaccgcgaacgccgtgtcccgagcgccgccgcctgcggacgcctcacgggccgggaagggatgcggcctttctcctaaggcaccagtttctccaatgtttaacttatacatgcatcagaatgacagtgaggcgttggtgagagctgctctggttgctaatggagatctggcctgccacagtgggagcagagcttgcccagtgcgccgggacgactgcgggctccatccattccgctcccagggcggttgtcggccaggaccgtgagctgtcaggtcccccgcgggatccttcctggagcttacactatagtaggaggcagccagtacttgcaagcacggggtcgcgggaactacgacctcacccaggccaggcgacctttctctcaagaaggagatgtcagaggcccctcgtgacagcgagcttccggggacagggctcctaatgtgtagagatggggtttcaccacgttggccaggatggtcttgatctcctgacctcatgatctgccttcctcagcctcctattgatcaaagttttacatgatgcaggagccttcagagtgaagacccaaagatacaggatacagtacgggatcctttctggaatggaggtcttatgagctgctattgaacacggcagagcctgttggtgacctgcacacaggagccctccagtcagtactgattgaattactcaaggctgcctctctgcaaagttgagcagcatttccatttcccaaaccggctctgatttcccagctggagcgaggggaaacaccctggtgctcggttcctcggggagctctggatggagaggccccaaggggcatctcctcagcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatgtacaaaaaaaaaaaaaaaaaaaaaaaaaaactcgagactagttccttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctccctgctcatggaacgtctctcagttgattatggcaagaaatccaagctggagttctccatttacccggcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagatgttaaagctttctggttagattgttttcacttggtgatcatgtcttttccatgtgtacctgtaatatttttccatcatatctcaaagtaaagtcattaacatc

SEQ ID NO: 436209 - DNA, 1111 bp, Homo sapiens
ccttgtgttgtgggtatagtgagaagagagcaaattcatggtgctccactgagccttcagttccctcccctctcggtttgcaagatccagcctaattccaagcatcctcatgaggatgtctgaacttgagagctctaagagggagaggacaggtaagaattgaggactcaattcctcaatgagtgaaatcatccatttgctgactcaaacagttactgagtcgtctgtcaacttcctgacctttgtaagtctcctggcccctctcttgtcctttcccctggaattccttttcttgttcttcctagttatttccgtttttttcccctcctacccctgaagacactggcctgggaggagccttgggattactgtgtgccatgccactcacctgcctgtcccatttctttccttttaagcagcatttccatttcccaaaccggctctgatttcccagctggagcgaggggaaacaccctggtgctcggttcctcggggagctctggatggagaggccccaaggggcatctcctcagcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatgtacaaa

SEQ ID NO: 436210 - DNA, 3961 bp, Homo sapiens
tgcccttttcccctcgggcagcggaggcgagcaccgcgaacgccgtgtcccgagcgccgccgcctgcggacgcctcacgggccgggaagggatgcggcctttctcctaaggcaccagtttctccaatgtttaacttatacatgcatcagaatgacagtgaggcgttggtgagagctgctctggttgctaatggagatctggcctgccacagtgggagcagagcttgcccagtgcgccgggacgactgcgggctccatccattccgctcccagggcggttgtcggccaggaccgtgagctgtcaggtcccccgcgggatccttcctggagcttacactatagtaggaggcagccagtacttgcaagcacggggtcgcgggaactacgacctcacccaggccaggcgacctttctctcaagaaggagatgtcagaggcccctcgtgacagcgagcttccggggacagggctcctaatgtgtagagatggggtttcaccacgttggccaggatggtcttgatctcctgacctcatgatctgccttcctcagcctcctattgatcaaagttttacatgatgcaggagccttcagagtgaagacccaaagatacaggatacagtacgggatcctttctggaatggaggtcttatgagctgctattgaacacggcagagcctgttggtgacctgcacacaggagccctccagtcagtactgattgaattactcaaggctgcctctctgcaaagttgaggcggtggagaactactgaggacttctgagcagagaggttggtggaagaggaagcaccaaaaatccatctcatcacctagagagcattgtactggcagaactgtctaaagtgactattttggaactctgggatcaatttgaatacttgcagcttccaaaggaaagatgggcaatcacatctccataccacaggacacaccccttggatgcatcctcaagaactgggaaaagtttgacccacaagctctaaaaaggaaaaggctaattttttttgtcacacagcctggttctgatatggacttggggaccagcaatcttggccagaaaatggaagtattaattttaatactatccatcaactagattcgttttgctgccagcagggaaaatggacagaaatcccttatgcacaggctttcatggccgtaagagacaaccctgacctttgttgggcttgtaaaatggacccagtgatgatagcagccatcaccaggcaactcctccagtagatttgggagaccctttatcagatttgcacagggctcaagccccagaggaaccaaaggtggaatttagttcaaacattgcctcttttattcccattatatccaagtctcccagtcccatagccttcccctccctacccagggccaccctctggataccacccccttaagttatccccacttcaggaggttagcagccctattgggtcaactagagtccagactccattcactatgtaagacctgagccagattaaaatggagctatggaagtttatggaaaaccctgactaatgcattgaagggttccattaactaggcttaacatttgaacttacttgggaggacttcacagtcacactaggccaaactctaagggagaacatgactccattatggaggcagcccagcaatttgcaagtgcaatgcacatgactgaccctggtggctaccttgtgagggccactgcccttccccaggttggcccccaactgggaatacaatacccaggggggtatatgggcagtgaaccacatccccataatggggatgaaggatagcagaggaaagcctgtaaactacaataaattggccttaatagatcaagactctcttgaaaatcccactactttcttagagaggctacattaggcccaagtgaaacatactaaccttgacccagacaccccagaaggatgccttcttttgtatccccatagacccatcttcccaattgctatttgcctttgaatgggaaaatgaaaaaggaaggagccaacagctcacctggactgtgcttctgcaaggttttagagatagtccccatttggttgggcaagccttggctaaagattttcaagacctgactcttgagggggcagatgtgtcctacagtatgtgaatgacctgctaatctcctcccccacaagacaactgggaatccaacatctagtccagacatctaaaagaagggactgatagggactcacttctctgggaaaaagatcaggagcaagcctttaggcagctaaagactgctctctcataagccccagcccttgggctacccatactaagcaaactgttttagcttttcatcaccaaaagccaaggtgtagccttaggagtcctaactcaaactgttgggtcaatcaaatgtcctgtaggttactttttaaagaacctagacccagtagcacacaggtggccacactgcctcaaggtagtggctgcacaagccctcctactggaggaggtcctcaaaatcaccatgatacaatcaatccagctcctgatgtccaacaaataagccccttactggacataaaagtgccacaatggctcactgacaacagattgctaaagtatcaagtgttgttagaaatcccacaggtaacagttgagtggtgctccaccctcatcccagcctccttactgccattaccaggagaggatgactcaacacattcatgttgtgagatacttaaccaaatttatgccagatgggaagacttaaaggatcagcccttggacaatctggtcaaaatatggttttcagatgggagcagttttgttcagaatgaaactatatatgcagggtacacagaggctaaagctctatccttggggacctcaggacaactagcaaaactcatcttttaaccacaggcctaacactaggggaagggaaaagaataaccatttatacagattccaaatatgcctttttggtgcttcatgcccaagccactatctggaaggaaagggagtacccagcaacttgggatactcctactaagtaggggccccaaatcttagagctactagaggccattcacttgacccaggaggtggcagtagagagggttctggaaatggcaggcactcattgggtaatggtcaagctatcataaaactgtccctctgaaatgagaagtggccatgactgggaccaagacagagaggagttctgcaacagatagaaaacatctggagccagcaaatcacaattccctgatcaggtttttgtttgtttttgttttgttttgttttgtttggggtggagtctcactctgtcacccaggctggagtacagtggcacgacctcggctcactgcaacctctgcctcccggattcaagtgattctcctgcctcagcctccccagtagctgagattacaggcacctgccaccacacctggctaattttttaaaatttttagtagagacaaggttttgccatgttggccaggctggtcttgaactcctgacctcaaatgatccacctgccttggcctcccaaagtgctgggcgtgagccaccgtgcccagcccctgatctggtcttaagcatggggcaaaagtagggggggaaatggtggtgtttgactggtatatgaccttcctctggaggtgatcaaccagtaagggaaaatcgctccaagtgagcatgcacacaacctcagtaaacacactgtgcatgtggcttctcccaagtactagcaggccactgcacatgtcacaactgagcaacagcccaccccaatggagggatcaagggaggagaagaaaaaccccggaaccaaaagccagtttataaaaatcctgagccaaaggctgaggggggcacttgatctctcaagttccctacttggccctcttccaagtgtgatttgcttcttttaataaacctttgcctctgcttt

SEQ ID NO: 436211 - DNA, 4315 bp, Homo sapiens
tgcccttttcccctcgggcagcggaggcgagcaccgcgaacgccgtgtcccgagcgccgccgcctgcggacgcctcacgggccgggaagggatgcggcctttctcctaaggcaccagtttctccaatgtttaacttatacatgcatcagaatgacagtgaggcgttggtgagagctgctctggttgctaatggagatctggcctgccacagtgggagcagagcttgcccagtgcgccgggacgactgcgggctccatccattccgctcccagggcggttgtcggccaggaccgtgagctgtcaggtcccccgcgggatccttcctggagcttacactatagtaggaggcagccagtacttgcaagcacggggtcgcgggaactacgacctcacccaggccaggcgacctttctctcaagaaggagatgtcagaggcccctcgtgacagcgagcttccggggacagggctcctaatgtgtagagatggggtttcaccacgttggccaggatggtcttgatctcctgacctcatgatctgccttcctcagcctcctattgatcaaagttttacatgatgcaggagccttcagagtgaagacccaaagatacaggatacagtacgggatcctttctggaatggaggtcttatgagctgctattgaacacggcaggtagctcatggtgctcccttccttggtgcagacgggcagttcaaaccacacaaactccagcctgtgggagagggatccttcatcctggacgcacctgccctctgcccagccactataaaaaccagagccacgtgccccttcttttgcttgagtgtgggccctgctgtccccagaaagcctcattacgcggtggagaactactgaggacttctgagcagagaggttggtggaagaggaagcaccaaaaatccatctcatcacctagagagcattgtactggcagaactgtctaaagtgactattttggaactctgggatcaatttgaatacttgcagcttccaaaggaaagatgggcaatcacatctccataccacaggacacaccccttggatgcatcctcaagaactgggaaaagtttgacccacaagctctaaaaaggaaaaggctaattttttttgtcacacagcctggttctgatatggacttggggaccagcaatcttggccagaaaatggaagtattaattttaatactatccatcaactagattcgttttgctgccagcagggaaaatggacagaaatcccttatgcacaggctttcatggccgtaagagacaaccctgacctttgttgggcttgtaaaatggacccagtgatgatagcagccatcaccaggcaactcctccagtagatttgggagaccctttatcagatttgcacagggctcaagccccagaggaaccaaaggtggaatttagttcaaacattgcctcttttattcccattatatccaagtctcccagtcccatagccttcccctccctacccagggccaccctctggataccacccccttaagttatccccacttcaggaggttagcagccctattgggtcaactagagtccagactccattcactatgtaagacctgagccagattaaaatggagctatggaagtttatggaaaaccctgactaatgcattgaagggttccattaactaggcttaacatttgaacttacttgggaggacttcacagtcacactaggccaaactctaagggagaacatgactccattatggaggcagcccagcaatttgcaagtgcaatgcacatgactgaccctggtggctaccttgtgagggccactgcccttccccaggttggcccccaactgggaatacaatacccaggggggtatatgggcagtgaaccacatccccataatggggatgaaggatagcagaggaaagcctgtaaactacaataaattggccttaatagatcaagactctcttgaaaatcccactactttcttagagaggctacattaggcccaagtgaaacatactaaccttgacccagacaccccagaaggatgccttcttttgtatccccatagacccatcttcccaattgctatttgcctttgaatgggaaaatgaaaaaggaaggagccaacagctcacctggactgtgcttctgcaaggttttagagatagtccccatttggttgggcaagccttggctaaagattttcaagacctgactcttgagggggcagatgtgtcctacagtatgtgaatgacctgctaatctcctcccccacaagacaactgggaatccaacatctagtccagacactacattttcttgcagacagagggtacaaagcatccaaggccaaggcacagcttctcagacaagaggtccaatacgtggggataatcctgatccctcgagaacataagttctccccagaacggatacaggccatccttaaaatacctatcccagccacccaaaatcagcatcaggcctttctagggatcacaggatattgcagactttagactgggttatggtgggattgttaagtccttatattagactctaaaagaagggactgatagggactcacttctctgggaaaaagatcaggagcaagcctttaggcagctaaagactgctctctcataagccccagcccttgggctacccatactaagcaaactgttttagcttttcatcaccaaaagccaaggtgtagccttaggagtcctaactcaaactgttgggtcaatcaaatgtcctgtaggttactttttaaagaacctagacccagtagcacacaggtggccacactgcctcaaggtagtggctgcacaagccctcctactggaggaggtcctcaaaatcaccatgatacaatcaatccagctcctgatgtccaacaaataagccccttactggacataaaagtgccacaatggctcactgacaacagattgctaaagtatcaagtgttgttagaaatcccacaggtaacagttgagtggtgctccaccctcatcccagcctccttactgccattaccaggagaggatgactcaacacattcatgttgtgagatacttaaccaaatttatgccagatgggaagacttaaaggatcagcccttggacaatctggtcaaaatatggttttcagatgggagcagttttgttcagaatgaaactatatatgcagggtacacagaggctaaagctctatccttggggacctcaggacaactagcaaaactcatcttttaaccacaggcctaacactaggggaagggaaaagaataaccatttatacagattccaaatatgcctttttggtgcttcatgcccaagccactatctggaaggaaagggagtacccagcaacttgggatactcctactaagtaggggccccaaatcttagagctactagaggccattcacttgacccaggaggtggcagtagagagggttctggaaatggcaggcactcattgggtaatggtcaagctatcataaaactgtccctctgaaatgagaagtggccatgactgggaccaagacagagaggagttctgcaacagatagaaaacatctggagccagcaaatcacaattccctgatcaggtttttgtttgtttttgttttgttttgttttgtttggggtggagtctcactctgtcacccaggctggagtacagtggcacgacctcggctcactgcaacctctgcctcccggattcaagtgattctcctgcctcagcctccccagtagctgagattacaggcacctgccaccacacctggctaattttttaaaatttttagtagagacaaggttttgccatgttggccaggctggtcttgaactcctgacctcaaatgatccacctgccttggcctcccaaagtgctgggcgtgagccaccgtgcccagcccctgatctggtcttaagcatggggcaaaagtagggggggaaatggtggtgtttgactggtatatgaccttcctctggaggtgatcaaccagtaagggaaaatcgctccaagtgagcatgcacacaacctcagtaaacacactgtgcatgtggcttctcccaagtactagcaggccactgcacatgtcacaactgagcaacagcccaccccaatggagggatcaagggaggagaagaaaaaccccggaaccaaaagccagtttataaaaatcctgagccaaaggctgaggggggcacttgatctctcaagttccctacttggccctcttccaagtgtgatttgcttcttttaataaacctttgcctctgcttt

SEQ ID NO: 436212 - DNA, 893 bp, Homo sapiens
ccttgtgttgtgggtatagtgagaagagagcaaattcatggtgctccactgagccttcagttccctcccctctcggtttgcaagatccagcctaattccaagcatcctcatgaggatgtctgaacttgagagctctaagagggagaggacaggtaagaattgaggactcaattcctcaatgagtgaaatcatccatttgctgactcaaacagttactgagtcgtctgtcaacttcctgacctttgtaagtctcctggcccctctcttgtcctttcccctggaattccttttcttgttcttcctagttatttccgtttttttcccctcctacccctgaagacactggcctgggaggagccttgggattactgtgtgccatgccactcacctgcctgtcccatttctttccttttaagcagcatttccatttcccaaaccggctctgatttcccagctggagcgaggggaaacaccctggtgctcggttcctcggggagctctggatggagaggccccaaggggcatctcctcagggataggtgaagaagaggccttcatcttttctatttcttcttgacgttttaaagatatccatttctaaagcctgctgggatttcccatcctgagcaggtggaagagccattaaacctgaaactgcaaggagagggtccaagcctgatttgtccgggggagattctcaagcttccaggtgctaccatatggagcctaaggataaagccaataccaaagaaaacagtgactaaacagagagaaactaggtccttggtgacatcttttgagccactagaccaagctttacctgaagcagagctacctcagaacttttcagctatgtgagccaataaacatctgtcaaacgaaaaaagaaaaaa

SEQ ID NO: 436213 - DNA, 1352 bp, Homo sapiens
tgcccttttcccctcgggcagcggaggcgagcaccgcgaacgccgtgtcccgagcgccgccgcctgcggacgcctcacgggccgggaagggatgcggcctttctcctaaggcaccagtttctccaatgtttaacttatacatgcatcagaatgacagtgaggcgttggtgagagctgctctggttgctaatggagatctggcctgccacagtgggagcagagcttgcccagtgcgccgggacgactgcgggctccatccattccgctcccagggcggttgtcggccaggaccgtgagctgtcaggtcccccgcgggatccttcctggagcttacactatagtaggaggcagccagtacttgcaagcacggggtcgcgggaactacgacctcacccaggccaggcgacctttctctcaagaaggagatgtcagaggcccctcgtgacagcgagcttccggggacagggctcctaatgtgtagagatggggtttcaccacgttggccaggatggtcttgatctcctgacctcatgatctgccttcctcagcctcctattgatcaaagttttacatgatgcaggagccttcagagtgaagacccaaagatacaggatacagtacgggatcctttctggaatggaggtcttatgagctgctattgaacacggcagcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggcggtggagaactactgaggacttctgagcagagaggttggtggaagaggaagcaccaaaaatccatctcatcacctagagagcattgtactggcagaactgtctaaagtgactattttggaactctgggatcaatttgaatacttgcagcttccaaaggaaaggtgggtaatcgtgccgtccataaaacaaagatggaaccgacagttacagggtacctgatgggccaatcacatcctccatacacaggagaaaccccgttggatgcctcctccaagaactggaac

SEQ ID NO: 436214 - DNA, 439 bp, Homo sapiens
ccctcactgtttcctggctctttccagtagaaaagagctgggctccctcactgtttcctggcacacggtatgatattgagttccatgattatgcatgtaccttgggttacaacccccctggcggcagaacctctattgtgtccttctttgtattgcccacagagcctgttggtgacctgcacacaggagccctccagtcagtactgattgaattactcaaggctgcctctctgcaaagttgaggtaagcagctgagttcaatgatgctggctgcattttcagctattggggctgcagtagctaggcaggggctgcaggcccttctggctttttagccctcctgctcacccaccatttacacagtcttcctttcagagcccccctttctcctcctgcacttccttgaatattgactgcctctctgatttccctcactttg

SEQ ID NO: 436215 - DNA, 675 bp, Homo sapiens
cgtttttgtcgcgggaggttttggtttgtgaggatcggcgagtggcgcccaccatctctgcttgctgaaaagctgcagaggccgccaggagcccacgcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatgtacaaa

SEQ ID NO: 436216 - DNA, 734 bp, Homo sapiens
ggggcctggcgggtgtggagcacggggagtcgggcgtggggcgggcagggagtggagtcggggtcttactccggtggctgcagggcgcagggtagccgtgtcaggcctgcccaggtgcagagcgctcctccgcgaccccaacagcctctggtccggtctggcgcgccctcgctttcccagagggcgacctgggctatggcggccgtggcgctggcgagcgggacacgcctcggccttgtcctcgagctgctcccgggacagcccgcgctgccccgggcgcgccgggagtcagtgaccttcgaggatgtggccgtctacttctctgagaacgaatggatcggcctgggccctgctcagagagccctgtacagggatgtgatgctggagaattatggggctgtggcttccctggcagcatttccatttcccaaaccggctctgatttcccagctggagcgaggggaaacaccctggtgctcggttcctcggggagctctggatggagaggccccaaggggcatctcctcaggggagattctcaagcttccaggtgctaccatatggagcctaaggataaagccaataccaaagaaaacagtgactaaacagagagaaactaggtccttggtgacatcttttgagccactagaccaagctttacctgaagcagagctacctcagaacttttcagctatgtgagccaataaacatctgtcaaacgaaaaaagaaaaaa

SEQ ID NO: 436217 - DNA, 756 bp, Homo sapiens
  misc_feature (625)..(625): n is a, c, g, or t
  misc_feature (739)..(739): n is a, c, g, or t
acttccctgaggaagaggcactggcgctgccgctctcctcccaggcttgtggtggacattctcaagcaagtcattctggctccgcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccaataanttaatggggctggttgttccccttgggcccggttcttccaatccccctggaataatggggttctttttggtttacaagaaccaccatttgaaaaaattccccaaaagggggttntttgtttggaaaacttg

SEQ ID NO: 436218 - DNA, 3569 bp, Homo sapiens
tgcccttttcccctcgggcagcggaggcgagcaccgcgaacgccgtgtcccgagcgccgccgcctgcggacgcctcacgggccgggaagggatgcggcctttctcctaaggcaccagtttctccaatgtttaacttatacatgcatcagaatgacagtgaggcgttggtgagagctgctctggttgctaatggagatctggcctgccacagtgggagcagagcttgcccagtgcgccgggacgactgcgggctccatccattccgctcccagggcggttgtcggccaggaccgtgagctgtcaggtcccccgcgggatccttcctggagcttacactatagtaggaggcagccagtacttgcaagcacggggtcgcgggaactacgacctcacccaggccaggcgacctttctctcaagaaggagatgtcagaggcccctcgtgacagcgagcttccggggacagggctcctaatgtgtagagatggggtttcaccacgttggccaggatggtcttgatctcctgacctcatgatctgccttcctcagcctcctattgatcaaagttttacatgatgcaggagccttcagagtgaagacccaaagatacaggatacagtacgggatcctttctggaatggaggtcttatgagctgctattgaacacggcagagcctgttggtgacctgcacacaggagccctccagtcagtactgattgaattactcaaggctgcctctctgcaaagttgagcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtattggttgtgtcttggtgaggctgaggcccgcaggccagggccgggctttaaaaatagctgcagccttggtggtggccttcttcgtgctatggttcccatacaatctcaccttgtttctgcatacgctgttggacctgcaagtattcgggaactgtgaggtcagccagcatctagactacgcactccaggtaacagagagcatcgccttccttcactgctgcttttcccccatcctgtatgccttctccagtcaccgcttccgccagtacctgaaggctttcctggctgccgtgcttggatggcacctggcacctggcactgcccaggcctcattatccagctgttctgagagcagcatacttactgcccaagaggaaatgactggcatgaatgaccttggagagaggcagtctgagaactaccctaacaaggaggatgtggggaataaatcagcctgagtgaccaaattttggtctggtgggaacagatgggaaccagctcaattgggtgtccactcaaagtgctctctccaggggcctcagtgactgtgttgctaaacccagtggtcagttctcagttctcagccatcagcagcatttgctcgccccgccttcttcctccactttcttcacttgcttccaggataccacgctttcttttctgaattgctacaatctttcttccttccttccttgcttccttccttccttccttccctctctccctccctccctccctcgcttcttcccttcctcctttcctcccttcctactttccttccttccttctgacagggtcttgctctattgctctgtcacccaggctggaatgcagtggcgagatctccgctcactgtagcctcctccccctgggttgaagcaattctcatgcctcagcctcccaagtagccaggactataggcacctgccaccatgcctggctaatttttgtattttttttctttctttctttcttttcttttttttttttttttgagacggagtctcactcttgttgcccaggctggacaacaatggcgcgatctcggctcactgcaacctccacctcccggattcaagcgattctcctgcctcagcctcctgagtagctggaactacatgcgcgtgccaccacgcacagctaatttttataattttagtagagatggggtttcactgcgttggccaggatgatctcgatctcttgaccttgggatccacccgccttggcctcccaaagtgctgggattacaggtgtgagccaccatgcctggccctaatttttgtgtttttattagaaacagagtttcaccatgttggccaggctggagaattgctgtaatagttttccaactggcccctgtccttcctctctcttgctctcctcccatctcatctgcacctagcagccagagtgatcctgatactctcggcctttacttccgcctccctcagagcagcagcctgtcaaaacaccagattacaacaaatttagtttaaaggtctcaattagcgttattggcaattctagaatcaggcaacagactcattgaatcaggaacagattcactccataaaatacagagagtgctgcaatgagctgggtagaagaggttagttttatagacaggaaggggctgtcaaaggcagaaagaaatgaagaacaaaaaaaaagattgatttttttttttttgagacaggatctcactctgtcatccaggctgaagtccaatcccacaatcatggctcactgcagccaccacctcctgagctcaagtgatcctcccatctaagcccccaagtagctaggactacaggagcacaccaccacacctggctaatttttgtattttttgtggagacagggtctcagtatgttacccaggttggactggaaacccttggctcaagcaatttgcctgcctcagcctcccaaagtgctgggattacaggcgtgagccactgcacagggccagattcatcatttcaaagttactttctatatgcggccggaacagggtggttgacatcagttttcttcaggttactttttaataatgattaaaacggggaacttcattatc

SEQ ID NO: 436219 - DNA, 5143 bp, Homo sapiens
gattgtagcatttctcctttcaggatacagtacgggatcctttctggaatggaggtcttatgagctgctattgaacacggcaggtagctcatggtgctcccttccttggtgcagacgggcagttcaaaccacacaaactccagcctgtgggagagggatccttcatcctggacgcacctgccctctgcccagccactataaaaaccagagccacgtgccccttcttttgcttgagtgtgggccctgctgtccccagaaagcctcattaccactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtattggttgtgtcttggtgaggctgaggcccgcaggccagggccgggctttaaaaatagctgcagccttggtggtggccttcttcgtgctatggttcccatacaatctcaccttgtttctgcatacgctgttggacctgcaagtattcgggaactgtgaggtcagccagcatctagactacgcactccaggtaacagagagcatcgccttccttcactgctgcttttcccccatcctgtatgccttctccagtcaccgcttccgccagtacctgaaggctttcctggctgccgtgcttggatggcacctggcacctggcactgcccaggcctcattatccagctgttctgagagcagcatacttactgcccaagaggaaatgactggcatgaatgaccttggagagaggcagtctgagaactaccctaacaaggaggatgtggggaataaatcagcctgagtgaccaaattttggtctggtgggaacagatgggaaccagctcaattgggtgtccactcaaagtgctctctccaggggcctcagtgactgtgttgctaaacccagtggtcagttctcagttctcagccatcagcagcatttgctcgccccgccttcttcctccactttcttcacttgcttccaggataccacgctttcttttctgaattgctacaatctttcttccttccttccttgcttccttccttccttccttccctctctccctccctccctccctcgcttcttcccttcctcctttcctcccttcctactttccttccttccttctgacagggtcttgctctattgctctgtcacccaggctggaatgcagtggcgagatctccgctcactgtagcctcctccccctgggttgaagcaattctcatgcctcagcctcccaagtagccaggactataggcacctgccaccatgcctggctaatttttgtattttttttctttctttctttcttttcttttttttttttttttgagacggagtctcactcttgttgcccaggctggacaacaatggcgcgatctcggctcactgcaacctccacctcccggattcaagcgattctcctgcctcagcctcctgagtagctggaactacatgcgcgtgccaccacgcacagctaatttttataattttagtagagatggggtttcactgcgttggccaggatgatctcgatctcttgaccttgggatccacccgccttggcctcccaaagtgctgggattacaggtgtgagccaccatgcctggccctaatttttgtgtttttattagaaacagagtttcaccatgttggccaggctggagaattgctgtaatagttttccaactggcccctgtccttcctctctcttgctctcctcccatctcatctgcacctagcagccagagtgatcctgatactctcggcctttacttccgcctccctcagagcagcagcctgtcaaaacaccagattacaacaaatttagtttaaaggtctcaattagcgttattggcaattctagaatcaggcaacagactcattgaatcaggaacagattcactccataaaatacagagagtgctgcaatgagctgggtagaagaggttagttttatagacaggaaggggctgtcaaaggcagaaagaaatgaagaacaaaaaaaaagattgatttttttttttttgagacaggatctcactctgtcatccaggctgaagtccaatcccacaatcatggctcactgcagccaccacctcctgagctcaagtgatcctcccatctaagcccccaagtagctaggactacaggagcacaccaccacacctggctaatttttgtattttttgtggagacagggtctcagtatgttacccaggttggactggaaacccttggctcaagcaatttgcctgcctcagcctcccaaagtgctgggattacaggcgtgagccactgcacagggccagattcatcatttcaaagttactttctatatgcggccggaacagggtggttgacatcagttttcttcaggttactttttaataatgattaaaacggggaacttcattatcatgagcatggttactgtctgcattattacgccaactgaaactgtcatgtttgggaatttggctgttaactctgtctccaggagtctcaaaggtcagataacaacttagttttggtttgaggacatggaactttaatacgacagattccattttggtttggtctggtcagctgggacctagtgcaggaggttagtccaaaacaatggccttccatagtttttacttaacaagcccaactccttacggtaatcctttaaggcctatgtgatctgcccccaccctggctacactctttgcccttatgtccaccagcctccagtgctccagacacaactgatctcaaatactcctgacacatccccctggggattcctcttcctggattactctcctctcagctgtctgcttggctcactctctcaccttctgaggtcttagctcagataccacctttcactcacctgtccaacctatttaacacaaactggcccatctctgacgctcctgatcttcctgatgctctatttttaaattttttcaatagtgcttatttctttcagacattgtatatgtttctcctatttgtgatgttcagtggctactgtccccacccacattgtcccagggtgaattccacaaggtaggggatcttggttaggctcactgctgtacccaaccccctaacacagggcctggtgtgtaggttttcagaaagtatctgtaaaatgcatgggtggaggagggagcattttccttctggcactgctggggaaaaagaacctaaggccctccactcaccagggttccacattctctgtagtccagctgggaaatgctattaaaaggaccattctcgtagccttgatggtggacccagcatctggcaatcaggagggccttgaagtactctgcctagggaatgtcccaggaccatatacagtctgcagaaggaggcagtgaacacacttggcctaggccccatctcaggagccttcacatctccctgggacctgcacaatcaagtccaaaatctttgtctgatgtcaaggctagggcttttgcaaataggatcccatacatcttccagccctcatactcctccactcccttttcatttcctgaacattccaacttctatgcctttgctcttgtgggctccctcatgtaattaggataatttccagccaggtattccctcacccttgttttacaactgaatcccactttctctgggactccactgcttggtcactctgccctgtgctttgagaggaggttgggtggagcatgggacatgggccatttactgccttcacatttccctggtcacggtgatttttttaggggtgggcacatgacctaggtagagccaatgaagtgcaatatcactagaacatgtgagaagagaggcatgaaaccgaagctgagagggtttgagatctggagctactccttcctccacccaaacttcagaaggtgaaggagatagtgcatgtgagtgagcagatcccgagggcactgtttgagcctcagaatcaaagcacttctgaagctagtcccaatcttggattcgacagttacaagaaccaataaattcctttccttgtggagtcatgttgttttgttacttgcaacctaaagattcctgactgatatactgtgcccagtgcttttctcttcatatctctaatgcttggcattctccctgccccctgacacatccactgagaagcctttccccagggagctgcctgcccacatggcatctctctctcccgagcttctaaagcacccactgctcttcccacctcatagaactacctggtgcaacctgcccacgtcccagcatgtctgccctgcacaattgaacgtggaacctggcacacaggaaaggaaactttttggtggatggaatggagggtaggagaacagacggctgggtgaatgtaagctccatgagagcagggactttgccatgtgtaaactctgcatcccctgtgcttcaacacatgctcagagcatagtagactttttttggaatgaatggataagttttt

SEQ ID NO: 436220 - DNA, 5115 bp, Homo sapiens
cttatccaagagtaagtgtcccagagtaagtgggattcagttataagacaaaggtgaggggatatcttggtgacataactattaagtggtgcagatggctccctaagcttttgctcttacttgctggactgcaggtactgatgtagatttgaagagtctattggacatcccagggcagcagcaaaagtgggtttagagaaaggtagagaatgctaggtctcaccatattttccccccgcagcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtattggttgtgtcttggtgaggctgaggcccgcaggccagggccgggctttaaaaatagctgcagccttggtggtggccttcttcgtgctatggttcccatacaatctcaccttgtttctgcatacgctgttggacctgcaagtattcgggaactgtgaggtcagccagcatctagactacgcactccaggtaacagagagcatcgccttccttcactgctgcttttcccccatcctgtatgccttctccagtcaccgcttccgccagtacctgaaggctttcctggctgccgtgcttggatggcacctggcacctggcactgcccaggcctcattatccagctgttctgagagcagcatacttactgcccaagaggaaatgactggcatgaatgaccttggagagaggcagtctgagaactaccctaacaaggaggatgtggggaataaatcagcctgagtgaccaaattttggtctggtgggaacagatgggaaccagctcaattgggtgtccactcaaagtgctctctccaggggcctcagtgactgtgttgctaaacccagtggtcagttctcagttctcagccatcagcagcatttgctcgccccgccttcttcctccactttcttcacttgcttccaggataccacgctttcttttctgaattgctacaatctttcttccttccttccttgcttccttccttccttccttccctctctccctccctccctccctcgcttcttcccttcctcctttcctcccttcctactttccttccttccttctgacagggtcttgctctattgctctgtcacccaggctggaatgcagtggcgagatctccgctcactgtagcctcctccccctgggttgaagcaattctcatgcctcagcctcccaagtagccaggactataggcacctgccaccatgcctggctaatttttgtattttttttctttctttctttcttttcttttttttttttttttgagacggagtctcactcttgttgcccaggctggacaacaatggcgcgatctcggctcactgcaacctccacctcccggattcaagcgattctcctgcctcagcctcctgagtagctggaactacatgcgcgtgccaccacgcacagctaatttttataattttagtagagatggggtttcactgcgttggccaggatgatctcgatctcttgaccttgggatccacccgccttggcctcccaaagtgctgggattacaggtgtgagccaccatgcctggccctaatttttgtgtttttattagaaacagagtttcaccatgttggccaggctggagaattgctgtaatagttttccaactggcccctgtccttcctctctcttgctctcctcccatctcatctgcacctagcagccagagtgatcctgatactctcggcctttacttccgcctccctcagagcagcagcctgtcaaaacaccagattacaacaaatttagtttaaaggtctcaattagcgttattggcaattctagaatcaggcaacagactcattgaatcaggaacagattcactccataaaatacagagagtgctgcaatgagctgggtagaagaggttagttttatagacaggaaggggctgtcaaaggcagaaagaaatgaagaacaaaaaaaaagattgatttttttttttttgagacaggatctcactctgtcatccaggctgaagtccaatcccacaatcatggctcactgcagccaccacctcctgagctcaagtgatcctcccatctaagcccccaagtagctaggactacaggagcacaccaccacacctggctaatttttgtattttttgtggagacagggtctcagtatgttacccaggttggactggaaacccttggctcaagcaatttgcctgcctcagcctcccaaagtgctgggattacaggcgtgagccactgcacagggccagattcatcatttcaaagttactttctatatgcggccggaacagggtggttgacatcagttttcttcaggttactttttaataatgattaaaacggggaacttcattatcatgagcatggttactgtctgcattattacgccaactgaaactgtcatgtttgggaatttggctgttaactctgtctccaggagtctcaaaggtcagataacaacttagttttggtttgaggacatggaactttaatacgacagattccattttggtttggtctggtcagctgggacctagtgcaggaggttagtccaaaacaatggccttccatagtttttacttaacaagcccaactccttacggtaatcctttaaggcctatgtgatctgcccccaccctggctacactctttgcccttatgtccaccagcctccagtgctccagacacaactgatctcaaatactcctgacacatccccctggggattcctcttcctggattactctcctctcagctgtctgcttggctcactctctcaccttctgaggtcttagctcagataccacctttcactcacctgtccaacctatttaacacaaactggcccatctctgacgctcctgatcttcctgatgctctatttttaaattttttcaatagtgcttatttctttcagacattgtatatgtttctcctatttgtgatgttcagtggctactgtccccacccacattgtcccagggtgaattccacaaggtaggggatcttggttaggctcactgctgtacccaaccccctaacacagggcctggtgtgtaggttttcagaaagtatctgtaaaatgcatgggtggaggagggagcattttccttctggcactgctggggaaaaagaacctaaggccctccactcaccagggttccacattctctgtagtccagctgggaaatgctattaaaaggaccattctcgtagccttgatggtggacccagcatctggcaatcaggagggccttgaagtactctgcctagggaatgtcccaggaccatatacagtctgcagaaggaggcagtgaacacacttggcctaggccccatctcaggagccttcacatctccctgggacctgcacaatcaagtccaaaatctttgtctgatgtcaaggctagggcttttgcaaataggatcccatacatcttccagccctcatactcctccactcccttttcatttcctgaacattccaacttctatgcctttgctcttgtgggctccctcatgtaattaggataatttccagccaggtattccctcacccttgttttacaactgaatcccactttctctgggactccactgcttggtcactctgccctgtgctttgagaggaggttgggtggagcatgggacatgggccatttactgccttcacatttccctggtcacggtgatttttttaggggtgggcacatgacctaggtagagccaatgaagtgcaatatcactagaacatgtgagaagagaggcatgaaaccgaagctgagagggtttgagatctggagctactccttcctccacccaaacttcagaaggtgaaggagatagtgcatgtgagtgagcagatcccgagggcactgtttgagcctcagaatcaaagcacttctgaagctagtcccaatcttggattcgacagttacaagaaccaataaattcctttccttgtggagtcatgttgttttgttacttgcaacctaaagattcctgactgatatactgtgcccagtgcttttctcttcatatctctaatgcttggcattctccctgccccctgacacatccactgagaagcctttccccagggagctgcctgcccacatggcatctctctctcccgagcttctaaagcacccactgctcttcccacctcatagaactacctggtgcaacctgcccacgtcccagcatgtctgccctgcacaattgaacgtggaacctggcacacaggaaaggaaactttttggtggatggaatggagggtaggagaacagacggctgggtgaatgtaagctccatgagagcagggactttgccatgtgtaaactctgcatcccctgtgcttcaacacatgctcagagcatagtagactttttttggaatgaatggataagttttt

SEQ ID NO: 436221 - DNA, 1447 bp, Homo sapiens
tgcccttttcccctcgggcagcggaggcgagcaccgcgaacgccgtgtcccgagcgccgccgcctgcggacgcctcacgggccgggaagggatgcggcctttctcctaaggcaccagtttctccaatgtttaacttatacatgcatcagaatgacagtgaggcgttggtgagagctgctctggttgctaatggagatctggcctgccacagtgggagcagagcttgcccagtgcgccgggacgactgcgggctccatccattccgctcccagggcggttgtcggccaggaccgtgagctgtcaggtcccccgcgggatccttcctggagcttacactatagtaggaggcagccagtacttgcaagcacggggtcgcgggaactacgacctcacccaggccaggcgacctttctctcaagaaggagatgtcagaggcccctcgtgacagcgagcttccggggacagggctcctaatgtgtagagatggggtttcaccacgttggccaggatggtcttgatctcctgacctcatgatctgccttcctcagcctcctattgatcaaagttttacatgatgcaggagccttcagagtgaagacccaaagatacaggatacagtacgggatcctttctggaatggaggtcttatgagctgctattgaacacggcagagcctgttggtgacctgcacacaggagccctccagtcagtactgattgaattactcaaggctgcctctctgcaaagttgagcagcatttccatttcccaaaccggctctgatttcccagctggagcgaggggaaacaccctggtgctcggttcctcggggagctctggatggagaggccccaaggggcatctcctcagcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatgtacaaa

SEQ ID NO: 436222 - DNA, 1107 bp, Homo sapiens
ggggcctggcgggtgtggagcacggggagtcgggcgtggggcgggcagggagtggagtcggggtcttactccggtggctgcagggcgcagggtagccgtgtcaggcctgcccaggtgcagagcgctcctccgcgaccccaacagcctctggtccggtctggcgcgccctcgctttcccagagggcgacctgggctatggcggccgtggcgctggcgagcgggacacgcctcggccttgtcctcgagctgctcccgggacagcccgcgctgccccgggcgcgccgggagtcagtgaccttcgaggatgtggccgtctacttctctgagaacgaatggatcggcctgggccctgctcagagagccctgtacagggatgtgatgctggagaattatggggctgtggcttccctggcagcatttccatttcccaaaccggctctgatttcccagctggagcgaggggaaacaccctggtgctcggttcctcggggagctctggatggagaggccccaaggggcatctcctcagcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatgtacaaa

SEQ ID NO: 436223 - DNA, 2921 bp, Homo sapiens
tgcccttttcccctcgggcagcggaggcgagcaccgcgaacgccgtgtcccgagcgccgccgcctgcggacgcctcacgggccgggaagggatgcggcctttctcctaaggcaccagtttctccaatgtttaacttatacatgcatcagaatgacagtgaggcgttggtgagagctgctctggttgctaatggagatctggcctgccacagtgggagcagagcttgcccagtgcgccgggacgactgcgggctccatccattccgctcccagggcggttgtcggccaggaccgtgagctgtcaggtcccccgcgggatccttcctggagcttacactatagtaggaggcagccagtacttgcaagcacggggtcgcgggaactacgacctcacccaggccaggcgacctttctctcaagaaggagatgtcagaggcccctcgtgacagcgagcttccggggacagggctcctaatgtgtagagatggggtttcaccacgttggccaggatggtcttgatctcctgacctcatgatctgccttcctcagcctcctattgatcaaagttttacatgatgcaggagccttcagagtgaagacccaaagatacaggatacagtacgggatcctttctggaatggaggtcttatgagctgctattgaacacggcagagcctgttggtgacctgcacacaggagccctccagtcagtactgattgaattactcaaggctgcctctctgcaaagttgaggcggtggagaactactgaggacttctgagcagagaggttggtggaagaggaagcaccaaaaatccatctcatcacctagagagcattgtactggcagaactgtctaaagtgactattttggaactctgggatcaatttgaatacttgcagcttccaaaggaaagatgggcaatcacatctccataccacaggacacaccccttggatgcatcctcaagaactgggaaaagtttgacccacaagctctaaaaaggaaaaggctaattttttttgtcacacagcctggttctgatatggacttggggaccagcaatcttggccagaaaatggaagtattaattttaatactatccatcaactagattcgttttgctgccagcagggaaaatggacagaaatcccttatgcacaggctttcatggccgtaagagacaaccctgacctttgttgggcttgtaaaatggacccagtgatgatagcagccatcaccaggcaactcctccagtagatttgggagaccctttatcagatttgcacagggctcaagccccagaggaaccaaaggtggaatttagttcaaacattgcctcttttattcccattatatccaagtctcccagtcccatagccttcccctccctacccagggccaccctctggataccacccccttaagttatccccacttcaggaggttagcagccctattgggtcaactagagtccagactccattcactatgtaagacctgagccagattaaaatggagctatggaagtttatggaaaaccctgactaatgcattgaagggttccattaactaggcttaacatttgaacttacttgggaggacttcacagtcacactaggccaaactctaagggagaacatgactccattatggaggcagcccagcaatttgcaagtgcaatgcacatgactgaccctggtggctaccttgtgagggccactgcccttccccaggttggcccccaactgggaatacaatacccaggggggtatatgggcagtgaaccacatccccataatggggatgaaggatagcagaggaaagcctgtaaactacaataaattggccttaatagatcaagactctcttgaaaatcccactactttcttagagaggctacattaggcccaagtgaaacatactaaccttgacccagacaccccagaaggatgccttcttttgtatccccatagacccatcttcccaattgctatttgcctttgaatgggaaaatgaaaaaggaaggagccaacagctcacctggactgtgcttctgcaaggttttagagatagtccccatttggttgggcaagccttggctaaagattttcaagacctgactcttgagggggcagatgtgtcctacagtatgtgaatgacctgctaatctcctcccccacaagacaactgggaatccaacatctagtccagacactacattttcttgcagacagagggtacaaagcatccaaggccaaggcacagcttctcagacaagaggtccaatacgtggggataatcctgatccctcgagaacataagttctccccagaacggatacaggccatccttaaaatacctatcccagccacccaaaatcagcatcaggcctttctagggatcacaggatattgcagactttagactgggttatggtgggattgttaagtccttatattagactctaaaagaagggactgatagggactcacttctctgggaaaaagatcaggagcaagcctttaggcagctaaagactgctctctcataagccccagcccttgggctacccatactaagcaaactgttttagcttttcatcaccaaaagccaaggtgtagccttaggagtcctaactcaaactgttgggtcaatcaaatgtcctgtaggttactttttaaagaacctagacccagtagcacacaggtggccacactgcctcaaggtagtggctgcacaagccctcctactggaggaggtcctcaaaatcaccatgatacaatcaatccagctcctgatgtccaacaaataagccccttactggacataaaagtgccacaatggctcactgacaacagattgctaaagtatcaagtgttgttagaaatcccacagagatagcgtcccccacagagaga

SEQ ID NO: 436224 - DNA, 959 bp, Homo sapiens
tgcccttttcccctcgggcagcggaggcgagcaccgcgaacgccgtgtcccgagcgccgccgcctgcggacgcctcacgggccgggaagggatgcggcctttctcctaaggcaccagtttctccaatgtttaacttatacatgcatcagaatgacagtgaggcgttggtgagagctgctctggttgctaatggagatctggcctgccacagtgggagcagagcttgcccagtgcgccgggacgactgcgggctccatccattccgctcccagggcggttgtcggccaggaccgtgagctgtcaggtcccccgcgggatccttcctggagcttacactatagtaggaggcagccagtacttgcaagcacggggtcgcgggaactacgacctcacccaggccaggcgacctttctctcaagaaggagatgtcagaggcccctcgtgacagcgagcttccggggacagggctcctaatgtgtagagatggggtttcaccacgttggccaggatggtcttgatctcctgacctcatgatctgccttcctcagcctcctattgatcaaagttttacatgatgcaggagccttcagagtgaagacccaaagatacaggatacagtacgggatcctttctggaatggaggtcttatgagctgctattgaacacggcaggtgagagaatttctttatggccaattcttagacaaaaagtaggggaagcggttgggcacagtggctcacgcctgtaatcctagcactttgggaggccaaggcgggtggatcacgagctcaggagtttgagaccagcctgaccaacatggtgataccccatctctactaaaaatacaaaaattagccaggcgtggtggcgtgcacctgtaatctcagctactcaggaggctaaggcaggagaattgtgtgaacctgggaggcagaggttgcagtgacccgagatcgcgc

SEQ ID NO: 436225 - DNA, 890 bp, Homo sapiens
gctggggaagaggccgatgcataaagtcagcctgttccaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaaaaaagggcggctggggaatggctgctgccatggtgccggggcgcagcgagagctgggagcgcggggagcctggccgcccggccctgtacttctgcgggagcattcgcggcggacgcgaggacaggacgctgtacgagcggatcgtgtctcggctgcggcgattcgggacagtgctcaccgagcacgtggcggccgccgagctgggcgcgcgcggggaagaggctgctgggggtgacaggctcatccatgagcaggacctggagtggctgcagcaggcggacgtggtcgtggcagaagtgacacagccatccttgggtgtaggctatgagctgggccgggccgtggcctttaacaagcggatcctgtgcctgttccgcccgcagtctggccgcgtgctttcggccatgatccggggagcagcagatggctctcggttccaggtgtgggactatgaggagggagaggtggaggccctgctggatcgatacttcgaggctgatcctccagggcaggtggctgcctcccctgacccaaccacttgacttaatctcactttcttaaattcttctattctcagacactgctctagtaccattccttcctcttagccccaggagcaaattaaaagggtacagttaaaatcctaa

SEQ ID NO: 436226 - DNA, 901 bp, Homo sapiens
  misc_feature (16)..(16): n is a, c, g, or t
tcaacaaccaaacatntattgagcacctactggtcagggccctggaaccactagactcttagtccagtgctcttcaggaccctggaggaccctctgcaatttggcctgagactccagccagcagctggaaactcctcgtccaggagactgtccaggtgaggagctcagcagtgaggagggcggaccccatcagcccacttgccaacctgcaatgccaccaccatcctgtggtccagagacatagaagtggcaggatgggggcggctggggaatggctgctgccatggtgccggggcgcagcgagagctgggagcgcggggagcctggccgcccggccctgtacttctgcgggagcattcgcggcggacgcgaggacaggacgctgtacgagcggatcgtgtctcggctgcggcgattcgggacagtgctcaccgagcacgtggcggccgccgagctgggcgcgcgcggggaagaggctgctgggggtgacaggctcatccatgagcaggacctggagtggctgcagcaggcggacgtggtcgtggcagaagtgacacagccatccttgggtgtaggctatgagctgggccgggccgtggcctttaacaagcggatcctgtgcctgttccgcccgcagtctggccgcgtgctttcggccatgatccggggagcagcagatggctctcggttccaggtgtgggactatgaggagggagaggtggaggccctgctggatcgatacttcgaggctgatcctccagggcaggtggctgcctcccctgacccaaccacttgacttaatctcactttcttaaattcttctattctcagacactgctctagtaccattccttcctcttagccccaggagcaaattaaaagggtacagttaaaatcctaa

SEQ ID NO: 436227 - DNA, 1041 bp, Homo sapiens
gctggggaagaggccgatgcataaagtcagcctgttccaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaaaaaagggcggctggggaatggctgctgccatggtgccggggcgcagcgagagctgggagcgcggggagcctggccgcccggccctgtacttctgcgggagcattcgcggcggacgcgaggacaggacgctgtacgagcggatcgtgtctcggctgcggcgattcgggacagtgctcaccgagcacgtggcggccgccgagctgggcgcgcgcggggaagaggctgctgggggtgacaggctcatccatgagcaggacctggagtggctgcagcaggcggacgtggtcgtggcagaagtgacacagccatccttgggtgtaggctatgagctgggccgggccgtggcctttaacaagcggatcctgtgcctgttccgcccgcagtctggccgcggtgagcaccccaagcctccctcctggctttctatggacccagccctcagctccttccctggtgggctctgagcaccgcgcctctcccaaggggtaagggagctgtgagggtgtggatgggaggcagcttcacctttccctgccctttccagtgctttcggccatgatccggggagcagcagatggctctcggttccaggtgtgggactatgaggagggagaggtggaggccctgctggatcgatacttcgaggctgatcctccagggcaggtggctgcctcccctgacccaaccacttgacttaatctcactttcttaaattcttctattctcagacactgctctagtaccattccttcctcttagccccaggagcaaattaaaagggtacagttaaaatcctaa

SEQ ID NO: 436228 - DNA, 801 bp, Homo sapiens
gctggggaagaggccgatgcataaagtcagcctgttccaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaaaaaagggcggctggggaatggctgctgccatggtgccggggcgcagcgagagctgggagcgcggggagcctggccgcccggccctgtacttctgcgggagcattcgcggcggacgcgaggacaggacgctgtacgagcggatcgtgtctcggctgcggcgattcgggacagtgctcaccgagcacgtggcggccgccgagctgggcgcgcgcggggaagaggctgctgggggtgacaggctcatccatgagcaggacctggagtggctgcagcaggcggacgtggtcgtggcagaagtgacacagccatccttgggtgtaggctatgagctgggccgggccgtggcctttaacaagcggatcctgtgcctgttccgcccgcagtctggccgcgtgctttcggccatgatccggggagcagcagatggctctcggttccaggtgtgggactatgaggaggcagccacctgccctggaggatcagcctcgaagtatcgatccagcagggcctccacctctccctcctcataggtcgacgcggccgcgaatttagtagtag

SEQ ID NO: 436229 - DNA, 666 bp, Homo sapiens
tgatgttcctcattcggccctaatcacatgtcccaccttgcatagggttgaatttttctttttgtggctattccatttcctcgctgctttgatgagattgtcatgtttggtcaggtcatctggcacaaggctcccaccctccctgagcagggtgggtatggacatacaagggcataggagttactgggagccagcatgaggcatgtccttgaccagctttccctcaacacaggggaagaggctgctgggggtgacaggctcatccatgagcaggacctggagtggctgcagcaggcggacgtggtcgtggcagaagtgacacagccatccttgggtgtaggctatgagctgggccgggccgtggcctttaacaagcggatcctgtgcctgttccgcccgcagtctggccgcgtgctttcggccatgatccggggagcagcagatggctctcggttccaggtgtgggactatgaggagggagaggtggaggccctgctggatcgatacttcgaggctgatcctccagggcaggtggctgcctcccctgacccaaccacttgacttaatctcactttcttaaattcttctattctcagacactgctctagtaccattccttcctcttagccccaggagcaaattaaaagggtacagttaaaatcctaa

SEQ ID NO: 436230 - DNA, 937 bp, Homo sapiens
  misc_feature (830)..(830): n is a, c, g, or t
  misc_feature (833)..(833): n is a, c, g, or t
  misc_feature (839)..(839): n is a, c, g, or t
  misc_feature (857)..(857): n is a, c, g, or t
  misc_feature (882)..(882): n is a, c, g, or t
  misc_feature (884)..(884): n is a, c, g, or t
  misc_feature (888)..(888): n is a, c, g, or t
  misc_feature (908)..(908): n is a, c, g, or t
gctggggaagaggccgatgcataaagtcagcctgttccaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaaaaaagggcggctggggaatggctgctgccatggtgccggggcgcagcgagagctgggagcgcggggagcctggccgcccggccctgtacttctgcgggagcattcgcggcggacgcgaggacaggacgctgtacgagcggatcgtgtctcggctgcggcgattcgggacagtgctcaccgagcacgtggcggccgccgagctgggcgcgcgcggggaagaggctgctgggggtgacaggctcatccatgagcaggacctggagtggctgcagcaggcggacgtggtcgtggcagaagtgacacagccatccttgggtgtaggctatgagctgggccgggccgtggcctttaacaagcggatcctgtgcctgttccgcccgcagtctggccgcgtgctttcggccatgatccggggagcagcagatggctctcggttccaggtgtgggactatgaggagggagaggtggaggccctgctggatcgatacttcgaggctgatcctccagggcaggtggctgcctcccctgacccaaccacttgacttaatctcactttcttaaaaattccttcctaattcctcaagacnaanttgctnctaagttaacccaatttncctttcccctctttaaaggcccccnangggnggcaaaaattttaaaaaaangggtaccaaaggtttaaaaaaattcccct

SEQ ID NO: 436231 - DNA, 329 bp, Homo sapiens
tttttgcaaaaaccaaggaaatgaattatttttaatatcacatatccaaaaaacgattatttcttattattctattattattctagtaattcagttttagattttactttggattttctatgaacaaaattacatcattagaagttaatgctaattttgtttgttttttcttcttataccttttctaaaaatttaacctagtaaatctggaagatcctcttatatcttttattttttggcttacttcagcacaggctagaatattcatttagaaactgggatgctggaaatagatcttattaaaaaatcatttatagtttctctttgtt

SEQ ID NO: 436232 - DNA, 1987 bp, Homo sapiens
aacaaacgcccatgtagccacaaccaggacatcaaatcccgtattttgtttcctttcctcctcccgtggaatctttgagtttattgcgcaccaccccctacatgttgccattcttttagtgcactcgtatatatccagaagcaatacacagtgatttttaactctcctagatgaaatatttccatctttgctggttttgtaggttttttggtgtggtgttgggaattatttccataccccatggctgtcaggctattcttctgtattttcttctgtgagtttggctttttcctgttctgcgtaggattcatgtgtgtgtacagagtaaggcagaaatcttaactgtacctttcccacccaaccagttgtcctggcaatgtgtggggtgccctcttccctgcctcactcccacacctgctgggcctggcttcgcccctgtcaggcatgacctgcgctgaccccctcttctctcagctaccgctcagctgtttttagcccatggctttcccccaaggacttttcccctaaggattttaggatcgccttatattcaccccaaagagtcctgttagattttcagttgcattgaatttacaggcgtggttggcatccttttccatgaatatggtacaaaactattacatcatttttggacgtgaagttttgactagatttagtttcaggtatcacatagattttgggggtctttggatttttgtgttgcctgtgattattccttagatcagaggaatcacagatgatcaaacctgcaaatacaaggtttggttctttccttttgaatttgtctgattgtcttgtcactccagtgctgccaaagagaggcactggtggggcccttgtctgtgaaactttaaagcatcccattaaagagtgaaggttcccatttccggagtttttcatcctttgattttttttttcttgatgttgctccatccttgttgaatttgttagtacttttaggatttttaatgtatgttcgttagtattagactctagttttattgtactttggtatccagattgtgagcactttccctgtttttcatttgctgaaacactgtgtataaggtagggatttgtcctgaaagatgtgaagtcactctcctgttcaaactaggcctggtatcttttggtagagcagaggctttattttattaattaaatctgtgctttaggtgtactctggcctttttccagcagcctaaactgaaagcctatttttttttttttgaaagctgcattttaaggccatcaaatttcttcctaatctgtatcaaattgcctttaggtcctggatcctttgtctttattcctgtgtattgggcttaatttagtgacgtttatgtatttatcggtacaattcaaagggctgggagcattgtggtccacaggagaggccttcgctggctgcactggagagaggttttgggctctgctgggcagggtgtgaagaggagagcacaaagcgggccttcgggctcctgcatacggaaaatacatcaccatctcctgtcttttcagagcaaaatctggagcggcaggtgttacagacacaatgtagacgactggaggcccggcactacagcctcagcctgacggcagagcagctctcccacagcgtggcggtgagttgggaagggatggaaaccttcaaacacgcaaccttttgagtttgggttcagaaacacccatgcagataagtttcagagaggaaatgtgctcttaagagatcaaaatttggcggatcacgaggtcaggagatcgagaccatcccggctaaaacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctc

SEQ ID NO: 436233 - DNA, 7462 bp, Homo sapiens
ggaggtggttgggggcagaccagcaccttcggcccaggggcagtgccagcttcctttgcccctgccctccacgtgggcaccagggccaggacatctgcggccaggtgggcagctgtcggcgcagttgacgtcttggctacatcgtggcactcgcttcacggcgtgctgggtgccaacggtgtctgcttccccgggtgtgtgtctggtgtgaccttcggatgtccacaccaggaggggtggaggcaggagcccctgccaccctgcatccttcacctgcacacattgtgtttctggggggttctagttcttttgctggactgaggaggcccagggagggagacggatcccgagacgcacttcaccccagacctgtcgcagccacatcccctttcttacggttctgcttcccacaccacatgcaccatgttttgcgtagaaagccttagggaaaggatgtttctagaacatgaactaaatctagcgccttcccgtgagtcaggagacctggctgtgtcctgtggtcagtggcctataccaggctcctgccctgactggacgctctcctcccgcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaacgggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattat

SEQ ID NO: 436234 - DNA, 7212 bp, Homo sapiens
cccacgcgtccgaaattatagcgtccggccaaggccgcaagggggggcgccgccggtgagctggcgggtcgtgcggggaagcagcacccccgcgccgtgccaggaccggccagcgtccgcagggtcctcactgagcagcgagtcgtcccccgtgtcctctccggccaccaaccacagctcccccgccagcacacccaagcgcgtgcccatgggccctatcatcgtcccccctgggggccacagcgtgcccagcaccccccccgtggtgaccatcgctccaaccaaaaccgtgaatggtgtctggaggagtgagagccggcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaacgggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattat

SEQ ID NO: 436235 - DNA, 5285 bp, Homo sapiens
gtgtttccctttgtcttagcgggctagtgacgtgttgattgccagcccagttccctagatacaaagcatctttttccctgaatttttggaggaaaaaaaattaagggcgatgcagcccttgagtttcacagtcaagaagggccgggtgacatcagggatctgctgcgtggaacatcgtggggtcatctttccccttcaggaagtggcagtaatggtaggagtgggggagaaggcaccctgcctcagaggccaggcctgggtctttggggtgtttctttgtgttggggccaccttgtctgacttgaaataagaatacatcctcgcacgtcaccaccgaggtccgtgggcacagtgattcacagaggcgtcgtcaccgcacggacagctgtctttggagcacgtctaggacattgtgtagtggatgccgagagcaatctgggctcgctttgagatggttgcttcctttcaactgggcctgccccatcacacctgcttttggtttttcgggctttagtgctttgcctgcccctcaaggctcggctagaatcccgctgtccttctctccaaaaaatgatgcaactggctcgttaatctcaggctgcttttctcatagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaacgggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattat

SEQ ID NO: 436236 - DNA, 8586 bp, Homo sapiens
ggaggtggttgggggcagaccagcaccttcggcccaggggcagtgccagcttcctttgcccctgccctccacgtgggcaccagggccaggacatctgcggccaggtgggcagctgtcggcgcagttgacgtcttggctacatcgtggcactcgcttcacggcgtgctgggtgccaacggtgtctgcttccccgggtgtgtgtctggtgtgaccttcggatgtccacaccaggaggggtggaggcaggagcccctgccaccctgcatccttcacctgcacacattgtgtttctggggggttctagttcttttgctggactgaggaggcccagggagggagacggatcccgagacgcacttcaccccagacctgtcgcagccacatcccctttcttacggttctgcttcccacaccacatgcaccatgttttgcgtagaaagccttagggaaaggatgtttctagaacatgaactaaatctagcgccttcccgtgagtcaggagacctggctgtgtcctgtggtcagtggcctataccaggctcctgccctgactggacgctctcctcccgcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaacgggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattatgttaagaggaaaatcttttttatgatataaaacaaagccaaacaaagaaaagctcaataactatacatctccgcagacggagctgcctccactggctcaggctctaagaggagggcattaggaccccttgccctccacaataacaagtggtttcattctaaaagatccccagatgaaagcaggaggattccaaggaaggctgagatgaaagaacaagtcctatgagctgaaccaagtctgaacagcaccttaaattatggagacctcatcttttggtcccagtcttccaggtctgacccttcagtgtccaaataaccaccaaaacctgcctggcggggacacgtgggcagcaacatggagtgatagtgtgcagcatgctagacactggagggcagatgctgggtgataagtctttaggctcagcctgtcacacatgcgcattctcagagctccccagacagcaccccactgcttttggcccactggtgtccagccaaaaataggctggccaggcatggcggctcatgcttgcaatcccagtgctttgggaggctgtggtgggagaactgtgtgaacccaggagttcgaggctgcagtgagctataatcacgccactctactgcagcctggatgacagaacgagaccctgtctaaaaaaaaaggttaaaaatttttttgtttgagacagagtcttgctctcgttgcccaggcaggagtacagtggtgcaatcttggctcactacaacctccgcctctcgggttcaagcgattctcctgcctcagcctcccgagtagctgcgactataggcgtgtgccaccgtgcccagccctgctggtctcgaacttctgacctcatgatccacccgcctcagcctcccgaaatgctgggattacaggcgtgagccactgtgcctggccaaaacattgtttttaattagtgggagccttttctttaaataaacactacccagatgctcaattggtaaatgagagttgctttcggagggtagggggtagcaggttagcacagagacagtggaagggagctcagtctctccggccttcgcaaggcaggctcaagtacctctaggtaccttcctcatgaacagttccaaacctttggc

SEQ ID NO: 436237 - DNA, 4615 bp, Homo sapiens
ggaggtggttgggggcagaccagcaccttcggcccaggggcagtgccagcttcctttgcccctgccctccacgtgggcaccagggccaggacatctgcggccaggtgggcagctgtcggcgcagttgacgtcttggctacatcgtggcactcgcttcacggcgtgctgggtgccaacggtgtctgcttccccgggtgtgtgtctggtgtgaccttcggatgtccacaccaggaggggtggaggcaggagcccctgccaccctgcatccttcacctgcacacattgtgtttctggggggttctagttcttttgctggactgaggaggcccagggagggagacggatcccgagacgcacttcaccccagacctgtcgcagccacatcccctttcttacggttctgcttcccacaccacatgcaccatgttttgcgtagaaagccttagggaaaggatgtttctagaacatgaactaaatctagcgccttcccgtgagtcaggagacctggctgtgtcctgtggtcagtggcctataccaggctcctgccctgactggacgctctcctcccgcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaacgggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttt

SEQ ID NO: 436238 - DNA, 4761 bp, Homo sapiens
ggaggtggttgggggcagaccagcaccttcggcccaggggcagtgccagcttcctttgcccctgccctccacgtgggcaccagggccaggacatctgcggccaggtgggcagctgtcggcgcagttgacgtcttggctacatcgtggcactcgcttcacggcgtgctgggtgccaacggtgtctgcttccccgggtgtgtgtctggtgtgaccttcggatgtccacaccaggaggggtggaggcaggagcccctgccaccctgcatccttcacctgcacacattgtgtttctggggggttctagttcttttgctggactgaggaggcccagggagggagacggatcccgagacgcacttcaccccagacctgtcgcagccacatcccctttcttacggttctgcttcccacaccacatgcaccatgttttgcgtagaaagccttagggaaaggatgtttctagaacatgaactaaatctagcgccttcccgtgagtcaggagacctggctgtgtcctgtggtcagtggcctataccaggctcctgccctgactggacgctctcctcccgcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaacgggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggtttttttttttttttttttttttttttttttttt

SEQ ID NO: 436239 - DNA, 4726 bp, Homo sapiens
ggaggtggttgggggcagaccagcaccttcggcccaggggcagtgccagcttcctttgcccctgccctccacgtgggcaccagggccaggacatctgcggccaggtgggcagctgtcggcgcagttgacgtcttggctacatcgtggcactcgcttcacggcgtgctgggtgccaacggtgtctgcttccccgggtgtgtgtctggtgtgaccttcggatgtccacaccaggaggggtggaggcaggagcccctgccaccctgcatccttcacctgcacacattgtgtttctggggggttctagttcttttgctggactgaggaggcccagggagggagacggatcccgagacgcacttcaccccagacctgtcgcagccacatcccctttcttacggttctgcttcccacaccacatgcaccatgttttgcgtagaaagccttagggaaaggatgtttctagaacatgaactaaatctagcgccttcccgtgagtcaggagacctggctgtgtcctgtggtcagtggcctataccaggctcctgccctgactggacgctctcctcccgcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaacgggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttggtgctcctagggaggcccagc

SEQ ID NO: 436240 - DNA, 4006 bp, Homo sapiens
ggaggtggttgggggcagaccagcaccttcggcccaggggcagtgccagcttcctttgcccctgccctccacgtgggcaccagggccaggacatctgcggccaggtgggcagctgtcggcgcagttgacgtcttggctacatcgtggcactcgcttcacggcgtgctgggtgccaacggtgtctgcttccccgggtgtgtgtctggtgtgaccttcggatgtccacaccaggaggggtggaggcaggagcccctgccaccctgcatccttcacctgcacacattgtgtttctggggggttctagttcttttgctggactgaggaggcccagggagggagacggatcccgagacgcacttcaccccagacctgtcgcagccacatcccctttcttacggttctgcttcccacaccacatgcaccatgttttgcgtagaaagccttagggaaaggatgtttctagaacatgaactaaatctagcgccttcccgtgagtcaggagacctggctgtgtcctgtggtcagtggcctataccaggctcctgccctgactggacgctctcctcccgcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggtgagttgggaagggatggaaaccttcaaacacgcaaccttttgagtttgggttcagaaacacccatgcagataagtttcagagaggaaatgtgctcttaagagatcaaaatttggcggatcacgaggtcaggagatcgagaccatcccggctaaaacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctc

SEQ ID NO: 436241 - DNA, 731 bp, Homo sapiens
acatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaaggtaatgaggctgccagtccctgctcagctctcggctgtggttgaggctgaccaaagttgctgagcgccacagctgctcagccgttcagccgtgggcacaagtttttataaactccaatcaccagaagaaaataatttcgttattatgccaaaaccatgtttgtttgtttatctccaagctctaaaacctgaactcgtaggtgagaaacgtttgtaggcaccagcgctgacgctgtgctgtgagcagggacgcatcgatcggtaagaggtaaaggagtgaacgccgacaggcattggtttttgcagagattaaaagattccccaaaggcaggaagagcacttgagtggatttttacccgcattcatttgaaagaatcatgtttttcaagacagagatgcagatggccaccagtcctcagggtagag

SEQ ID NO: 436242 - DNA, 7171 bp, Homo sapiens
ccagcatgtatcagccgaggtggagctgcggggccctggcatgaaagggtcctcactgagcagcgagtcgtcccccgtgtcctctccggccaccaaccacagctcccccgccagcacacccaagcgcgtgcccatgggccctatcatcgtcccccctgggggccacagcgtgcccagcaccccccccgtggtgaccatcgctccaaccaaaaccgtgaatggtgtctggaggagtgagagccggcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaacgggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattataaaaaaaaaacacagaaaaaaacaaaaagcaaag

SEQ ID NO: 436243 - DNA, 7488 bp, Homo sapiens
  misc_feature (196)..(196): n is a, c, g, or t
  misc_feature (269)..(269): n is a, c, g, or t
  misc_feature (390)..(390): n is a, c, g, or t
tgcatctcaagtccaaaaggcagaaaatacacacgcggcgaagacacccgggcagccgtggaggctccggcccgtccttggtcgtcaattacctcattgtggatctgccagggccaaggtggccgaaattgcctgggcgctggtcggagagagagccttttgatcatcttgcggggggggggggaaagactgattntttttttttttcgtcgctctcgggatcgctcttctgcctttattttattgttttggacatttttgagcgccgnggcttgaacggtgctttttgttcattcctgggttttaatattattttccttcttcatccctctctggccactatggaattctaatttgaaccatgtttggattgaagccgcctctgtattncttaccagggtcctcactgagcagcgagtcgtcccccgtgtcctctccggccaccaaccacagctcccccgccagcacacccaagcgcgtgcccatgggccctatcatcgtcccccctgggggccacagcgtgcccagcaccccccccgtggtgaccatcgctccaaccaaaaccgtgaatggtgtctggaggagtgagagccggcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaacgggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattat

SEQ ID NO: 436244 - DNA, 5443 bp, Homo sapiens
aacaaacgcccatgtagccacaaccaggacatcaaatcccgtattttgtttcctttcctcctcccgtggaatctttgagtttattgcgcaccaccccctacatgttgccattcttttagtgcactcgtatatatccagaagcaatacacagtgatttttaactctcctagatgaaatatttccatctttgctggttttgtaggttttttggtgtggtgttgggaattatttccataccccatggctgtcaggctattcttctgtattttcttctgtgagtttggctttttcctgttctgcgtaggattcatgtgtgtgtacagagtaaggcagaaatcttaactgtacctttcccacccaaccagttgtcctggcaatgtgtggggtgccctcttccctgcctcactcccacacctgctgggcctggcttcgcccctgtcaggcatgacctgcgctgaccccctcttctctcagctaccgctcagctgtttttagcccatggctttcccccaaggacttttcccctaaggattttaggatcgccttatattcaccccaaagagtcctgttagattttcagttgcattgaatttacaggcgtggttggcatccttttccatgaatatggtacaaaactattacatcatttttggacgtgaagttttgactagatttagtttcaggtatcacatagattttgggggtctttggatttttgtgttgcctgtgattattccttagatcagaggaatcacagatgatcaaacctgcaaatacaaggtttggttctttccttttgaatttgtctgattgtcttgtcactccagtgctgccaaagagaggcactggtggggcccttgtctgtgaaactttaaagcatcccattaaagagtgaaggttcccatttccggagtttttcatcctttgattttttttttcttgatgttgctccatccttgttgaatttgttagtacttttaggatttttaatgtatgttcgttagtattagactctagttttattgtactttggtatccagattgtgagcactttccctgtttttcatttgctgaaacactgtgtataaggtagggatttgtcctgaaagatgtgaagtcactctcctgttcaaactaggcctggtatcttttggtagagcagaggctttattttattaattaaatctgtgctttaggtgtactctggcctttttccagcagcctaaactgaaagcctatttttttttttttgaaagctgcattttaaggccatcaaatttcttcctaatctgtatcaaattgcctttaggtcctggatcctttgtctttattcctgtgtattgggcttaatttagtgacgtttatgtatttatcggtacaattcaaagggctgggagcattgtggtccacaggagaggccttcgctggctgcactggagagaggttttgggctctgctgggcagggtgtgaagaggagagcacaaagcgggccttcgggctcctgcatacggaaaatacatcaccatctcctgtcttttcagagcaaaatctggagcggcaggtgttacagacacaatgtagacgactggaggcccggcactacagcctcagcctgacggcagagcagctctcccacagcgtggcggagttgaggagccagaaacagaagatggtctcagaacgggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattat

SEQ ID NO: 436245 - DNA, 3420 bp, Homo sapiens
ttgaagtagatcctctcccacattatttattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattat

SEQ ID NO: 436246 - DNA, 4959 bp, Homo sapiens
ggaggtggttgggggcagaccagcaccttcggcccaggggcagtgccagcttcctttgcccctgccctccacgtgggcaccagggccaggacatctgcggccaggtgggcagctgtcggcgcagttgacgtcttggctacatcgtggcactcgcttcacggcgtgctgggtgccaacggtgtctgcttccccgggtgtgtgtctggtgtgaccttcggatgtccacaccaggaggggtggaggcaggagcccctgccaccctgcatccttcacctgcacacattgtgtttctggggggttctagttcttttgctggactgaggaggcccagggagggagacggatcccgagacgcacttcaccccagacctgtcgcagccacatcccctttcttacggttctgcttcccacaccacatgcaccatgttttgcgtagaaagccttagggaaaggatgtttctagaacatgaactaaatctagcgccttcccgtgagtcaggagacctggctgtgtcctgtggtcagtggcctataccaggctcctgccctgactggacgctctcctcccgcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaacgggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcaaaaaaaaaaacaaaatgttgcggcacatgggcccctcgaaaacagcttacaaccaccccttgggcccaggcccaagagggaacacaacaagtggccaaagcgggccccagagaaaactcggggaccacacaaagggcgaaaatccacacaatatgaaaaggccgggggaaacgcgggccttcagaacacctcacagg

SEQ ID NO: 436247 - DNA, 4449 bp, Homo sapiens
ggaggtggttgggggcagaccagcaccttcggcccaggggcagtgccagcttcctttgcccctgccctccacgtgggcaccagggccaggacatctgcggccaggtgggcagctgtcggcgcagttgacgtcttggctacatcgtggcactcgcttcacggcgtgctgggtgccaacggtgtctgcttccccgggtgtgtgtctggtgtgaccttcggatgtccacaccaggaggggtggaggcaggagcccctgccaccctgcatccttcacctgcacacattgtgtttctggggggttctagttcttttgctggactgaggaggcccagggagggagacggatcccgagacgcacttcaccccagacctgtcgcagccacatcccctttcttacggttctgcttcccacaccacatgcaccatgttttgcgtagaaagccttagggaaaggatgtttctagaacatgaactaaatctagcgccttcccgtgagtcaggagacctggctgtgtcctgtggtcagtggcctataccaggctcctgccctgactggacgctctcctcccgcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaacgggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggatccgtgggagatggccaaactttggtatcaccagttaaacccacagattggtctct

SEQ ID NO: 436248 - DNA, 2549 bp, Homo sapiens
ggaggtggttgggggcagaccagcaccttcggcccaggggcagtgccagcttcctttgcccctgccctccacgtgggcaccagggccaggacatctgcggccaggtgggcagctgtcggcgcagttgacgtcttggctacatcgtggcactcgcttcacggcgtgctgggtgccaacggtgtctgcttccccgggtgtgtgtctggtgtgaccttcggatgtccacaccaggaggggtggaggcaggagcccctgccaccctgcatccttcacctgcacacattgtgtttctggggggttctagttcttttgctggactgaggaggcccagggagggagacggatcccgagacgcacttcaccccagacctgtcgcagccacatcccctttcttacggttctgcttcccacaccacatgcaccatgttttgcgtagaaagccttagggaaaggatgtttctagaacatgaactaaatctagcgccttcccgtgagtcaggagacctggctgtgtcctgtggtcagtggcctataccaggctcctgccctgactggacgctctcctcccgcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgaggtactgggctctcctccccacggacatgct

SEQ ID NO: 436249 - DNA, 970 bp, Homo sapiens
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttcca

SEQ ID NO: 436250 - DNA, 957 bp, Homo sapiens
gacccacgcgtcgcccacgcgtcgctcatggcggcggcggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttcca

SEQ ID NO: 436251 - DNA, 340 bp, Homo sapiens
  misc_feature (21)..(21): n is a, c, g, or t
cactatcaaaactgccacagnaaatagtctccacaaatatcctaatcccagcacacctcgtgggaaaaaaaagaaggctttgccagcatctgagaccccaaaagctgcagagtctgcagacccccagggaaagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttcca

SEQ ID NO: 436252 - DNA, 1248 bp, Homo sapiens
ttaggctaggtacgaggctgggtgttgctcatggcggcggcggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattca

SEQ ID NO: 436253 - DNA, 843 bp, Homo sapiens
  misc_feature (798)..(798): n is a, c, g, or t
  misc_feature (807)..(807): n is a, c, g, or t
  misc_feature (812)..(813): n is a, c, g, or t
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggaacggctggagtangaaagcagnctccnngggcccaaaaaggcgagttggttcgttccc

SEQ ID NO: 436254 - DNA, 857 bp, Homo sapiens
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagtagccagtctaccaccaccacagcaccccagacagctaggcttagcccctctgccctcccttcattgtactttatcattaaaaatcaacttcca

SEQ ID NO: 436255 - DNA, 1225 bp, Homo sapiens
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattca

SEQ ID NO: 436256 - DNA, 802 bp, Homo sapiens
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagaccggaatatccgggcaagccgcagggaaggcccttcccactggtggacacgcaggagccagggaagggcggaacggccggcccccggcgggccccaaggggccccgggccc

SEQ ID NO: 436257 - DNA, 930 bp, Homo sapiens
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccagctatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttcca

SEQ ID NO: 436258 - DNA, 630 bp, Homo sapiens
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtgagacacctcctgttgtgattctgcacctccccctctcccctccccccgagatagagagctcctcagatacatgtggctagagagccataa

SEQ ID NO: 436259 - DNA, 639 bp, Homo sapiens
  misc_feature (25)..(28): n is a, c, g, or t
cttcctcagtgggcttttcatatgnnnnagctgttcacgagttgggttttgccccaacccaccccccctgtcctatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattca

SEQ ID NO: 436260 - DNA, 1258 bp, Homo sapiens
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattca

SEQ ID NO: 436261 - DNA, 956 bp, Homo sapiens
ttaggctaggtacgaggctgggtgttgctcatggcggcggcggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtctacaccaccaagacccgaagtaggtagcccttgcctcctattgtctttcttaaataaatcagccggtggtgtactgtggtggggggca

SEQ ID NO: 436262 - DNA, 1420 bp, Homo sapiens
  misc_feature (1378)..(1378): n is a, c, g, or t
  misc_feature (1404)..(1405): n is a, c, g, or t
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattcaaaaaaaaaaaaagaaaaaaaaaaaaatggggggcgccttgggccaattaattttagatcaagcaaccttttcttgcggcccaattttagctcccttggcccatcgccctaataggggcgnttaaaaccacctggcccgcggttacnnggggggcgggggccc

SEQ ID NO: 436263 - DNA, 966 bp, Homo sapiens
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtctacaccaccaagacccgaagtaggtagcccttgcctcctattgtctttcttaaataaatcagccggtggtgtactgtggtggggggca

SEQ ID NO: 436264 - DNA, 1319 bp, Homo sapiens
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaagggaaattaggttggtctttcaggcatcttctaaaggcagccacctgccgttcgcgacagggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattca

SEQ ID NO: 436265 - DNA, 1369 bp, Homo sapiens
  misc_feature (660)..(660): n is a, c, g, or t
  misc_feature (662)..(662): n is a, c, g, or t
  misc_feature (664)..(664): n is a, c, g, or t
  misc_feature (697)..(697): n is a, c, g, or t
  misc_feature (701)..(701): n is a, c, g, or t
  misc_feature (704)..(704): n is a, c, g, or t
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccaggtgagcagngngntggggctgctggggctctgggacccagtgcttncggngtnggggctgggctggggtcagtgggcaacctcagtatctttccattctcatctcatgccagaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttgcccggggctccaggtagcctgcaggttaactggcggtaagtgctagactgtaagcccgacaagggcagggcttttggttttgttctctgatgtgtctcagtatctagcacataatagacactcaataaatacttgttgaattca

SEQ ID NO: 436266 - DNA, 798 bp, Homo sapiens
gaagtggactgggtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtggtggaggaacgatgtgtttactgtgtgaactctgacaacagtggctggactgaaatccgccgggaagcctgggtctcctctagcttatttggtgtctccagagctgtccagtgtagcagtgttgttgtcggctgctcggggctctgtcgacccaggtgcttttcgatgttcggggcgtgggctgggggtcatgtagggcaatctcaccactgttgcttcactgtttgagttagggtacctgctgctcgaagttcagta

SEQ ID NO: 436267 - DNA, 434 bp, Homo sapiens
gtttactgtgtgaactctgacaacagtggctggactgaaatccgccgggaagcctgggtctcctctagcttatttggtgtctccagagctgtccaggaatttggtcttgcccggttcaaaagcaacgtgaccaagactatgaagggttttgaatatatcttggctaagctgcaaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcccctctgccctcccttcattgtactttatcattaaaaatcaacttccaaaaaaaaaaaaaaaaaaga

SEQ ID NO: 436268 - DNA, 7991 bp, Homo sapiens
  misc_feature (1531)..(1531): n is a, c, g, or t
tgatggcggcggcgctggggcccccagaagtgatcgctcagctggagaacgcggctaaagttctgatggcaccaccttccatggtcaataatgaacaacgccagcatgcagagcacatattcttatcatttaggaaatcaaaatcaccatttgcagtttgcaagcatattttggaaactagtaaagtggactatgtcctctttcaagctgccacagccataatggaagcagttgtccgagagtggattctcttggaaaaaggtagcatcgagtctctgcgaacattccttttaacctatgtcttacaaaggcccaaccttcaaaagtatgttcgggaacagattctactagcagtagcagtaattgtaaaaagaggatcattagataaatcaattgactgcaaaagcatttttcatgaagtcagccagttgattagtagtggcaatcccactgtgcaaactctggcctgttctattctgactgcgctattgagtgaattttcaagttcaagtaaaactagcaacattggattgagcatggaattccatggtaactgcaaaagagtttttcaggaagaagaccttcgtcagatcttcatgttaactgttgaagttctgcaggagttcagcaggcgggaaaacctcaatgctcagatgtcttcagtatttcagcgttaccttgcactcgccaatcaagtcttgagctggaactttcttcctccaaatttgggcagacattatatagctatgtttgaatcctcgcaaaatgtgctgttgaagccaacagagtcctggcgggagactcttctggacagcagagttatggagcttttcttcacagtacatcgaaaaatcagagaagattcagatatggcacaagattctctgcagtgccttgcccagttagcttctcttcatggacccatcttcccagatgaaggatcacaagttgattatctagcacacttcattgagggattactgaatactatcaatggaattgaaatagaagattctgaagctgtggggatctccagcattatcagcaacctgataaccgtgttcccacgaaatgttttaactgccattccaagtgaacttttctcctcctttgttaactgcctcacacacctcacttgttcttttgggcgaagtgctgcattggaagaagtgcttgataaagatgacatggtatacatggaagcatatgataaattgttggagtcctggttaactttggttcaagatgacaaacatttccataaaggcttttttacccaacatgcagttcaagttttcaattcctatattcagtgccacctagctgctccagatggcacaagaaatttgactgccaatggtgtggcctctcgtgaggaggaagaaataagtgaacttcaagaggatgatcgagaccagttttctgatcaactggccagtgtaggaatgctaggaagaattgctgcagaacactgtatacctcttctgacaagtttattagaagaaagagtaacaagactccatggtcagtnacaacgacatcagcaacagttacttgcttcaccgggttcaagcactgttgacaacaaaatgcttgatgatctctatgaagatattcactggcttattttagttacaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacaacagaacagattctgtgattaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaagggcaaacttagtaattcaatgtgagaactggtggaatttagctaagcagtttgcaagccgaagcccacctcttaatttcttgtcaagtcctgtgcagaggacattgatgaaggctctagtcttaggaggttttgcacatatggacacagaaaccaaacagcagtattggacagaggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagagtccaaagctatgaacttatatgaagcctgccttactttgttgcaagtgtattctaagaataatttagggcggcaaagaatagatgttacagcagaagaagagcaataccaagacctgcttctcattatggaacttcttactaacctgctgtcaaaagaattcatagatttcagtgatacagatgaagtgtttagaggacatgagccaggtcaagcagcaaacagatctgtgtcagcagcggatgttgtgttgtatggagtaaacctaattctgcccttgatgtcacaggatctcttgaagtttccaaccctttgtaatcagtactacaaattaatcacatttatctgtgagatttttcctgaaaaaataccacagcttcctgaggatctgtttaaaagtctgatgtactccctagaattaggaatgacatcaatgagttcggaggtttgccagctttgcctggaggccttgacaccgttagctgaacagtgtgcaaaagcacaagaaacagactcaccactttttctagcaacacggcactttcttaagctggtttttgatatgctggttttgcaaaagcacaacacagagatgaccactgcggctggcgaagctttctacacgttggtgtgtttgcaccaggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttagatcctttctgcaaagtgcactgaattgctgaaagttgacttgagtcttgtcctattcctcagttcatttggccattttggattttggagagcctgaaactttgatatgtatgtaatacagtgaaacaggagaggtcaacttggcatcagcttctgctgttaagtgttagccacaatctgtcatatatatgtcttttagattctgaatggtgatttaaaattttcaaaatgaaattccatatatgtgcaaacagatatgggcaccacgaaatacatatgcagtgccttttttccttttaacataggtggctagccaaagtttagaatttttgtcattaaatatgaaatggatatatgctaggcagtgtttctcaaaatctccatagatcgcctgcatcacttgaggagctggtgaaaaggcagattcttaggcccaactgtagaccttcagagtcagaatgtctggttgttgggcccaggagtcttcatgttaataagcttctccctttcgtcaccccaaaagttttgaatcaatgaaagagacattgaaaactcttaagaggttttgtgctttctagcttttcctccctttgatgattgggttttataattcagcaggaaggggaaacatcaccaggggtttgttggctttttcttagcttgctttcttgcttgcttgctttcttgcttttcttgctttctgtctctctctttcttttctctctctctctcacatcaacccagtgctgcaggttttgtgtaatacaagtcactaatcatactctgatgcctgaacttgaggaggaaaatacatgtatatttttgttccgtaaaaataaccttaggaactgtagccatttcattgccttaattttaagaggagttggtttagggtgttagctgctatgaacctgttgcccctttcgatcgtgtatttatgtaggtttatcagtgaaatgaaaggcttgtttccgtctagtctaactttttgagtgtgtttctatccagccacatagcccatatctactctaaatggcttgcttaagcaataattattttaaaggatgtgaatcactgattcacacagactattgcacgttggggcattaggggcaataattcttatccagacatgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataacttacatttctctcaatttgattagctttgagtcacaattaaggggaagcaaaaacatcttgaaaagactgctaggaaggaaattaatatcagtcatccagaagtacacgtttctgtattttaaaaaatactttgatgcatttatttttaggtgttttttttttccccttaaaaaacttgaagtgatatgcagcagtaatctatttgttttgcattgttcttggtgttttgtgtttcccagatccctcaagctttctcagctgttgcgaattatgtgtatctgtgtgtgtgctaagtacagtctctttaccaaagggcactgaaacacacaattgactggacaggtccacgcgccatgacaaaactataatcaagttattaaaactaaagaggagtgggaaaggaatgccttggtaagtaaaaaggcatctatatttaataacttttatccagatggcaacatatttgcaaaatttgcccagatcctattacaatactaaaaatagaaaatttcacctccatattcctgaggtgtaatttcattagactagttttagtttaaaaagaccttcttcagattggaccaaataatacttataagatcagcagaatgttgaatattagctcactggggtggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctcttggcccagtgggtgtcaagaacactggcttaattcaagtcagttgattttttttctattaaaactgttgttaaaatattttttaaaacaaaaacattatttgtgccctcttttatatatgtcaaagggacactgtcaagtatttcatttttagatttttgttttataaaatttctgttgttcatatagtatcctttaacctctagttttccatacatcctttgtttgtttctcattttattttccttgacccatttatttcccaaggcacaatcactaaagactttgtactttcacagtctgttaatgtggtagcacctgtaactgtgttcttgttctgttaaaaggattgatttgcttttatagtccttgtgctggatgagtggctgcctcagtagcaaaactacctgacagtatttgacagtgtcctttccagcaccattatttgggtctttcagggtggccatctctgttagaagacagtagcatgttaacatcactgcattgagtttttgtctggtgtaaagtatgacttttaatgtaaacaaactgcaggtttttttcaaactaattttaagaatttagtcttatttcgttgtaaactgtgtatctaattatattacattactctgttcagatgggatggttactaccacttgtccatgattttcatttgaaaagcaagtatctatatcatttccccccagtcagcattatttaacactccccttaactgtctttgaactttctcttttaacaaaaatgtcaagtctttatagttgtaatatcaccatgtttcccatttctgttaatacttctatgaacccctaaagtattgaagggaactagctgtcagtttcaaggattacaagtttgagtctcctagtattcaacatcattctgaaccctgaaataatatttttctctgttaaacaatttttatctgtttgccacctctgttgttagaggtggttgtcaattgaccttactaagttagctgtctttgatgaggaattattgttattggttcctgaataaaacattaaccttttaagtcagaaggaacctcggtacttcttaaggtttgtttgtgttttctaaaaccagagaataaggaactgatttggctatgaggtttaacattataattttctgtaagctttcccacaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcatttagatataaaatatatgaagtatgctttgttgattatagtgagaacccatgacatagttaaccaaagaatatgtttggttcaaataaaaatagaagcttaatactgggcattcatactttttaaagagaatgaatgaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgtggtttgatcttcacctattcccaggccctcccagcaattggagaggtgtctttttttttggttttggttttttttctccccgtctgcattcttaggcctcttagctattaggaactgtcagatacatactagtagctaattttcctagcctgaaattatatactgcatctgcactatgtacctactagggatctgacctcaagtgttttctgagcccaggcttcctggtgtggtgtcttttaccacataaaattattacaaattgcaaatgttggtattgtgatttgattatctgtacaaagaaagaagctctatgcagtgagtttgtggtttaatggtcacaaaaatgttagcactgctaccactcagcacgtgtaaaattttttaaatttataaatattaaaattttaaactta

SEQ ID NO: 436269 - DNA, 8309 bp, Homo sapiens
  misc_feature (1531)..(1531): n is a, c, g, or t
tgatggcggcggcgctggggcccccagaagtgatcgctcagctggagaacgcggctaaagttctgatggcaccaccttccatggtcaataatgaacaacgccagcatgcagagcacatattcttatcatttaggaaatcaaaatcaccatttgcagtttgcaagcatattttggaaactagtaaagtggactatgtcctctttcaagctgccacagccataatggaagcagttgtccgagagtggattctcttggaaaaaggtagcatcgagtctctgcgaacattccttttaacctatgtcttacaaaggcccaaccttcaaaagtatgttcgggaacagattctactagcagtagcagtaattgtaaaaagaggatcattagataaatcaattgactgcaaaagcatttttcatgaagtcagccagttgattagtagtggcaatcccactgtgcaaactctggcctgttctattctgactgcgctattgagtgaattttcaagttcaagtaaaactagcaacattggattgagcatggaattccatggtaactgcaaaagagtttttcaggaagaagaccttcgtcagatcttcatgttaactgttgaagttctgcaggagttcagcaggcgggaaaacctcaatgctcagatgtcttcagtatttcagcgttaccttgcactcgccaatcaagtcttgagctggaactttcttcctccaaatttgggcagacattatatagctatgtttgaatcctcgcaaaatgtgctgttgaagccaacagagtcctggcgggagactcttctggacagcagagttatggagcttttcttcacagtacatcgaaaaatcagagaagattcagatatggcacaagattctctgcagtgccttgcccagttagcttctcttcatggacccatcttcccagatgaaggatcacaagttgattatctagcacacttcattgagggattactgaatactatcaatggaattgaaatagaagattctgaagctgtggggatctccagcattatcagcaacctgataaccgtgttcccacgaaatgttttaactgccattccaagtgaacttttctcctcctttgttaactgcctcacacacctcacttgttcttttgggcgaagtgctgcattggaagaagtgcttgataaagatgacatggtatacatggaagcatatgataaattgttggagtcctggttaactttggttcaagatgacaaacatttccataaaggcttttttacccaacatgcagttcaagttttcaattcctatattcagtgccacctagctgctccagatggcacaagaaatttgactgccaatggtgtggcctctcgtgaggaggaagaaataagtgaacttcaagaggatgatcgagaccagttttctgatcaactggccagtgtaggaatgctaggaagaattgctgcagaacactgtatacctcttctgacaagtttattagaagaaagagtaacaagactccatggtcagtnacaacgacatcagcaacagttacttgcttcaccgggttcaagcactgttgacaacaaaatgcttgatgatctctatgaagatattcactggcttattttagttacaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacaacagaacagattctgtgattaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaagggcaaacttagtaattcaatgtgagaactggtggaatttagctaagcagtttgcaagccgaagcccacctcttaatttcttgtcaagtcctgtgcagaggacattgatgaaggctctagtcttaggaggttttgcacatatggacacagaaaccaaacagcagtattggacagaggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagagtccaaagctatgaacttatatgaagcctgccttactttgttgcaagtgtattctaagaataatttagggcggcaaagaatagatgttacagcagaagaagagcaataccaagacctgcttctcattatggaacttcttactaacctgctgtcaaaagaattcatagatttcagtgatacagatgaagtgtttagaggacatgagccaggtcaagcagcaaacagatctgtgtcagcagcggatgttgtgttgtatggagtaaacctaattctgcccttgatgtcacaggatctcttgaagtttccaaccctttgtaatcagtactacaaattaatcacatttatctgtgagatttttcctgaaaaaataccacagcttcctgaggatctgtttaaaagtctgatgtactccctagaattaggaatgacatcaatgagttcggaggtttgccagctttgcctggaggccttgacaccgttagctgaacagtgtgcaaaagcacaagaaacagactcaccactttttctagcaacacggcactttcttaagctggtttttgatatgctggttttgcaaaagcacaacacagagatgaccactgcggctggcgaagctttctacacgttggtgtgtttgcaccaggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttagatcctttctgcaaagtgcactgaattgctgaaagttgacttgagtcttgtcctattcctcagttcatttggccattttggattttggagagcctgaaactttgatatgtatgtaatacagtgaaacaggagaggtcaacttggcatcagcttctgctgttaagtgttagccacaatctgtcatatatatgtcttttagattctgaatggtgatttaaaattttcaaaatgaaattccatatatgtgcaaacagatatgggcaccacgaaatacatatgcagtgccttttttccttttaacataggtggctagccaaagtttagaatttttgtcattaaatatgaaatggatatatgctaggcagtgtttctcaaaatctccatagatcgcctgcatcacttgaggagctggtgaaaaggcagattcttaggcccaactgtagaccttcagagtcagaatgtctggttgttgggcccaggagtcttcatgttaataagcttctccctttcgtcaccccaaaagttttgaatcaatgaaagagacattgaaaactcttaagaggttttgtgctttctagcttttcctccctttgatgattgggttttataattcagcaggaaggggaaacatcaccaggggtttgttggctttttcttagcttgctttcttgcttgcttgctttcttgcttttcttgctttctgtctctctctttcttttctctctctctctcacatcaacccagtgctgcaggttttgtgtaatacaagtcactaatcatactctgatgcctgaacttgaggaggaaaatacatgtatatttttgttccgtaaaaataaccttaggaactgtagccatttcattgccttaattttaagaggaaaatacaaaaacagctgatttgttttagtaagaaaccacgtcttgatgcttcagagttggtttagggtgttagctgctatgaacctgttgcccctttcgatcgtgtatttatgtaggtttatcagtgaaatgaaaggcttgtttccgtctagtctaactttttgagtgtgtttctatccagccacatagcccatatctactctaaatggcttgcttaagcaataattattttaaaggatgtgaatcactgattcacacagactattgcacgttggggcattaggggcaataattcttatccagacatgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataacttacatttctctcaatttgattagctttgagtcacaattaaggggaagcaaaaacatcttgaaaagactgctaggaaggaaattaatatcagtcatccagaagtacacgtttctgtattttaaaaaatactttgatgcatttatttttaggtgttttttttttccccttaaaaaacttgaagtgatatgcagcagtaatctatttgttttgcattgttcttggtgttttgtgtttcccagatccctcaagctttctcagctgttgcgaattatgtgtatctgtgtgtgtgctaagtacagtctctttaccaaagggcactgaaacacacaattgactggacaggtccacgcgccatgacaaaactataatcaagttattaaaactaaagaggagtgggaaaggaatgccttggtaagtaaaaaggcatctatatttaataacttttatccagatggcaacatatttgcaaaatttgcccagatcctattacaatactaaaaatagaaaatttcacctccatattcctgaggtgtaatttcattagactagttttagtttaaaaagaccttcttcagattggaccaaataatacttataagatcagcagaatgttgaatattagctcactggggtggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctcttggcccagtgggtgtcaagaacactggcttaattcaagtcagttgattttttttctattaaaactgttgttaaaatattttttaaaacaaaaacattatttgtgccctcttttatatatgtcaaagggacactgtcaagtatttcatttttagatttttgttttataaaatttctgttgttcatatagtatcctttaacctctagttttccatacatcctttgtttgtttctcattttattttccttgacccatttatttcccaaggcacaatcactaaagactttgtactttcacagtctgttaatgtggtagcacctgtaactgtgttcttgttctgttaaaaggattgatttgcttttatagtccttgtgctggatgagtggctgcctcagtagcaaaactacctgacagtatttgacagtgtcctttccagcaccattatttgggtctttcagggtggccatctctgttagaagacagtagcatgttaacatcactgcattgagtttttgtctggtgtaaagtatgacttttaatgtaaacaaactgcaggtttttttcaaactaattttaagaatttagtcttatttcgttgtaaactgtgtatctaattatattacattactctgttcagatgggatggttactaccacttgtccatgattttcatttgaaaagcaagtatctatatcatttccccccagtcagcattatttaacactccccttaactgtctttgaactttctcttttaacaaaaatgtcaagtctttatagttgtaatatcaccatgtttcccatttctgttaatacttctatgaacccctaaagtattgaagggaactagctgtcagtttcaaggattacaagtttgagtctcctagtattcaacatcattctgaaccctgaaataatatttttctctgttaaacaatttttatctgtttgccacctctgttgttagaggtggttgtcaattgaccttactaagttagctgtctttgatgaggaattattgttattggttcctgaataaaacattaaccttttaagtcagaaggaacctcggtacttcttaaggtttgtttgtgttttctaaaaccagagaataaggaactgatttggctatgaggtttaacattataattttctgtaagctttcccacaaaaaaacattgttgatttgaggatataataatgttttaatctttttaaaatataagtggttattctctgacttggtaactatgttctgaaaacactgcatttaagaatttttaaaaattggttttctaaaattaaaatgtccaaattaggcatattgctgagctcaaattgatgtgaaatgccatggttccagttgaattttaagcatattttcatttagatataaaatatatgaagtatgctttgttgattatagtgagaacccatgacatagttaaccaaagaatatgtttggttcaaataaaaatagaagcttaatactgggcattcatactttttaaagagaatgaatgaagaaatcggtttcctgctgtagttctctatgggtaagtcttagtaaagacgagaatgctgaagtcggccgtggcgattccctcctaggaactgggaggtgtggcttgcccattacccgcttgaagctcacatctttaccctcctctcccactgtggtttgatcttcacctattcccaggccctcccagcaattggagaggtgtctttttttttggttttggttttttttctccccgtctgcattcttaggcctcttagctattaggaactgtcagatacatactagtagctaattttcctagcctgaaattatatactgcatctgcactatgtacctactagggatctgacctcaagtgttttctgagcccaggcttcctggtgtggtgtcttttaccacataaaattattacaaattgcaaatgttggtattgtgatttgattatctgtacaaagaaagaagctctatgcagtgagtttgtggtttaatggtcacaaaaatgttagcactgctaccactcagcacgtgtaaaattttttaaatttataaatattaaaattttaaacttacactaagacttttcagttttatttaaagacccagggatgagtgtactgtttaaatatttacctctattaacataactaatgaaggtataaaattgcatttagtttttcagaagatgctgcaatatgattttaggaaataaggctatgtattgagccagttataggctgaatatcaggttgataaaattttatttgtatttttaaaattcataaatgggagttaaaatgtgtcttttcactaaatatttttattacaaaaatgt

SEQ ID NO: 436270 - DNA, 6993 bp, Homo sapiens
  misc_feature (1531)..(1531): n is a, c, g, or t
tgatggcggcggcgctggggcccccagaagtgatcgctcagctggagaacgcggctaaagttctgatggcaccaccttccatggtcaataatgaacaacgccagcatgcagagcacatattcttatcatttaggaaatcaaaatcaccatttgcagtttgcaagcatattttggaaactagtaaagtggactatgtcctctttcaagctgccacagccataatggaagcagttgtccgagagtggattctcttggaaaaaggtagcatcgagtctctgcgaacattccttttaacctatgtcttacaaaggcccaaccttcaaaagtatgttcgggaacagattctactagcagtagcagtaattgtaaaaagaggatcattagataaatcaattgactgcaaaagcatttttcatgaagtcagccagttgattagtagtggcaatcccactgtgcaaactctggcctgttctattctgactgcgctattgagtgaattttcaagttcaagtaaaactagcaacattggattgagcatggaattccatggtaactgcaaaagagtttttcaggaagaagaccttcgtcagatcttcatgttaactgttgaagttctgcaggagttcagcaggcgggaaaacctcaatgctcagatgtcttcagtatttcagcgttaccttgcactcgccaatcaagtcttgagctggaactttcttcctccaaatttgggcagacattatatagctatgtttgaatcctcgcaaaatgtgctgttgaagccaacagagtcctggcgggagactcttctggacagcagagttatggagcttttcttcacagtacatcgaaaaatcagagaagattcagatatggcacaagattctctgcagtgccttgcccagttagcttctcttcatggacccatcttcccagatgaaggatcacaagttgattatctagcacacttcattgagggattactgaatactatcaatggaattgaaatagaagattctgaagctgtggggatctccagcattatcagcaacctgataaccgtgttcccacgaaatgttttaactgccattccaagtgaacttttctcctcctttgttaactgcctcacacacctcacttgttcttttgggcgaagtgctgcattggaagaagtgcttgataaagatgacatggtatacatggaagcatatgataaattgttggagtcctggttaactttggttcaagatgacaaacatttccataaaggcttttttacccaacatgcagttcaagttttcaattcctatattcagtgccacctagctgctccagatggcacaagaaatttgactgccaatggtgtggcctctcgtgaggaggaagaaataagtgaacttcaagaggatgatcgagaccagttttctgatcaactggccagtgtaggaatgctaggaagaattgctgcagaacactgtatacctcttctgacaagtttattagaagaaagagtaacaagactccatggtcagtnacaacgacatcagcaacagttacttgcttcaccgggttcaagcactgttgacaacaaaatgcttgatgatctctatgaagatattcactggcttattttagttacaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacaacagaacagattctgtgattaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaagggcaaacttagtaattcaatgtgagaactggtggaatttagctaagcagtttgcaagccgaagcccacctcttaatttcttgtcaagtcctgtgcagaggacattgatgaaggctctagtcttaggaggttttgcacatatggacacagaaaccaaacagcagtattggacagaggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagagtccaaagctatgaacttatatgaagcctgccttactttgttgcaagtgtattctaagaataatttagggcggcaaagaatagatgttacagcagaagaagagcaataccaagacctgcttctcattatggaacttcttactaacctgctgtcaaaagaattcatagatttcagtgatacagatgaagtgtttagaggacatgagccaggtcaagcagcaaacagatctgtgtcagcagcggatgttgtgttgtatggagtaaacctaattctgcccttgatgtcacaggatctcttgaagtttccaaccctttgtaatcagtactacaaattaatcacatttatctgtgagatttttcctgaaaaaataccacagcttcctgaggatctgtttaaaagtctgatgtactccctagaattaggaatgacatcaatgagttcggaggtttgccagctttgcctggaggccttgacaccgttagctgaacagtgtgcaaaagcacaagaaacagactcaccactttttctagcaacacggcactttcttaagctggtttttgatatgctggttttgcaaaagcacaacacagagatgaccactgcggctggcgaagctttctacacgttggtgtgtttgcaccaggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttagatcctttctgcaaagtgcactgaattgctgaaagttgacttgagtcttgtcctattcctcagttcatttggccattttggattttggagagcctgaaactttgatatgtatgtaatacagtgaaacaggagaggtcaacttggcatcagcttctgctgttaagtgttagccacaatctgtcatatatatgtcttttagattctgaatggtgatttaaaattttcaaaatgaaattccatatatgtgcaaacagatatgggcaccacgaaatacatatgcagtgccttttttccttttaacataggtggctagccaaagtttagaatttttgtcattaaatatgaaatggatatatgctaggcagtgtttctcaaaatctccatagatcgcctgcatcacttgaggagctggtgaaaaggcagattcttaggcccaactgtagaccttcagagtcagaatgtctggttgttgggcccaggagtcttcatgttaataagcttctccctttcgtcaccccaaaagttttgaatcaatgaaagagacattgaaaactcttaagaggttttgtgctttctagcttttcctccctttgatgattgggttttataattcagcaggaaggggaaacatcaccaggggtttgttggctttttcttagcttgctttcttgcttgcttgctttcttgcttttcttgctttctgtctctctctttcttttctctctctctctcacatcaacccagtgctgcaggttttgtgtaatacaagtcactaatcatactctgatgcctgaacttgaggaggaaaatacatgtatatttttgttccgtaaaaataaccttaggaactgtagccatttcattgccttaattttaagaggaaaatacaaaaacagctgatttgttttagtaagaaaccacgtcttgatgcttcagagttggtttagggtgttagctgctatgaacctgttgcccctttcgatcgtgtatttatgtaggtttatcagtgaaatgaaaggcttgtttccgtctagtctaactttttgagtgtgtttctatccagccacatagcccatatctactctaaatggcttgcttaagcaataattattttaaaggatgtgaatcactgattcacacagactattgcacgttggggcattaggggcaataattcttatccagacatgggagccagtgaatttaatttcagagattaaaaattcactttagatcctctagtttgatctcttaatcaggatttttatacagctgccaggctcccctaattcagtgtgccagcttacaatgtggaaatgaaagctaatttatacacagcaggcatatgaaactccactcattgcagtactttcacagcacagtgacaggtagaggactctggcacaggtgcactcatgaaactctgcttccaccatgttcctgacacctatctattaaaccattctgcaaatacggtttttctacctgattgcatatagcatatgtgtcattacatgtgatgctgtgcaaaactttgtataattctgtgttattaacagttaacaaaactggagcatctgaattacatccaacctgtgcatgtgatgttaggtagatgtgaatgcagggccttgggccataacttacatttctctcaatttgattagctttgagtcacaattaaggggaagcaaaaacatcttgaaaagactgctaggaaggaaattaatatcagtcatccagaagtacacgtttctgtattttaaaaaatactttgatgcatttatttttaggtgttttttttttccccttaaaaaacttgaagtgatatgcagcagtaatctatttgttttgcattgttcttggtgttttgtgtttcccagatccctcaagctttctcagctgttgcgaattatgtgtatctgtgtgtgtgctaagtacagtctctttaccaaagggcactgaaacacacaattgactggacaggtccacgcgccatgacaaaactataatcaagttattaaaactaaagaggagtgggaaaggaatgccttggtaagtaaaaaggcatctatatttaataacttttatccagatggcaacatatttgcaaaatttgcccagatcctattacaatactaaaaatagaaaatttcacctccatattcctgaggtgtaatttcattagactagttttagtttaaaaagaccttcttcagattggaccaaataatacttataagatcagcagaatgttgaatattagctcactggggtggggagaagccactaccattttttaggtgatggggatgccactgagttgcaacggctagaccttttcagggtggttgtgtccatgtttgcctgattggatgcttattcactttgtgttttcttttgttttattttgtccaattttgtctttagctgtgtttattaacttctccggtcttgttttgttttaatgctcttggcccagtgggtgtcaagaacactggcttaattcaagtcagttgattttttttctattaaaactgttgttaaaatattttttaaaacaaaaacattatttgtgccctcttttatatatgtcaaagggacactgtcaagtatttcatttttagatttttgttttataaaatttctgttgttcatatagtatcctttaacctctagttttccatacatcctttgtttgtttctcattttattttccttgacccatttatttcccaaggcacaatcactaaagactttgtactttcacagtctgttaatgtggtagcacctgtaactgtgttcttgttctgttaaaaggattgatttgcttttatagtccttgtgctggatgagtggctgcctcagtagcaaaactacctgacagtatttgacagtgtcctttccagcaccattatttgggtctttcagggtggccatctctgttagaagacagtagcatgttaacatcactgcattgagtttttgtctggtgtaaagtatgacttttaatgtaaacaaactgcaggtttttttcaaactaattttaagaatttagtcttatttcgttgtaaactgtgtatctaattatattacattactctgttcagatgggatggttactaccacttgtccatgattttcatttgaaaagcaagtatctatatcatttctccccgtctgcattcttaggcctcttagctattaggaactgtcagatacatactagtagctaattttcctagcctgaaattatatactgcatctgcactatgtacctactagggatctgacctcaagtgttttctgagcccaggcttcctggtgtggtgtcttttaccacataaaattattacaaattgcaaatgttggtattgtgatttgattatctgtacaaagaaagaagctctatgcagtgagtttgtggtttaatggtcacaaaaatgttagcactgctaccactcagcacgtgtaaaattttttaaatttataaatattaaaattttaaactta

SEQ ID NO: 436271 - DNA, 738 bp, Homo sapiens
tgatggcggcggcgctggggcccccagaagtgatcgctcagctggagaacgcggctaaagttctgatggcaccaccttccatggtcaataatgaacaacgccagcatgcagagcacatattcttatcatttaggaaatcaaaatcaccatttgcagtttgcaagcatattttggaaactagtaaagtggactatgtcctctttcaagctgccacagccataatggaagcagttgtccgagagtggattctcttggaaaaaggtagcatcgagtctctgcgaacattccttttaacctatgtcttacaaaggcccaaccttcaaaagtatgttcgggaacagattctactagcagtagcagtaattgtaaaaagaggatcattagataaatcaattgactgcaaaagcatttttcatgaagtcagccagttgattagtagtggcaatcccactgtggtaagtgtgctatttgtatttataaatattaacaatttatattttctgttacacaaatagcattatagcaagagtaatggatatctacataaaaatagtgaaaaagctatcagtcaagcaattttcatttgttcaggttttcttctagtctttttttttttttttcccttgtgacaagagttttgctcttgttgcccaggccagaggttgcagtgagccgagatcattgcatcactgcactccagcctggtgacagagcaagactccttctcaaaaaaaaaaa
